United States Patent 12,270,029 (CFTR-MODULATING COMPOSITIONS AND METHODS) - sequence listing, part 6

SEQ ID NO: 7437 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7438 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7439 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7440 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7441 - protein, 2125 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7442 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7443 - protein, 2094 aa, synthetic construct; identical to SEQ ID NO: 4533

SEQ ID NO: 7444 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7445 - protein, 2094 aa, synthetic construct; identical to SEQ ID NO: 7444

SEQ ID NO: 7446 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7447 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7448 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7449 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7450 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7451 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7452 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7453 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7454 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7455 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7456 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7457 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7458 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7459 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7460 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7461 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7462 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7463 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7464 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7465 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7466 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7467 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7468 - protein, 2009 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGHLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPLAGKRTADGSEFEKRTADGSEFESPKKKAKVE

SEQ ID NO: 7469 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7470 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7471 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLIAGKRTADGSEFEKRTADGSEFESPKKKAKVE

SEQ ID NO: 7472 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7473 - protein, 2096 aa, synthetic construct; identical to SEQ ID NO: 7471

SEQ ID NO: 7474 - protein, 2096 aa, synthetic construct; identical to SEQ ID NO: 7472

SEQ ID NO: 7475 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7476 - protein, 2096 aa, synthetic construct; identical to SEQ ID NO: 4534

SEQ ID NO: 7477 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7478 - protein, 2096 aa, synthetic construct; identical to SEQ ID NO: 4534

SEQ ID NO: 7479 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 7480 - protein, 2088 aa, synthetic construct; identical to SEQ ID NO: 7479

SEQ ID NO: 7481 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7482 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7483 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 7484 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7485 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7486 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7487 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7488 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7489 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7490 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7491 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7492 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7493 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7494 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7495 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7496 - protein, 2096 aa, synthetic construct; identical to SEQ ID NO: 4535

SEQ ID NO: 7497 - protein, 2096 aa, synthetic construct; identical to SEQ ID NO: 4535

SEQ ID NO: 7498 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 7499 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7500 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7501 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGKAGFCRLFIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7502 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7503 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7504 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7505 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7506 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7507 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7508 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7509 - protein, 2096 aa, synthetic construct; identical to SEQ ID NO: 4536

SEQ ID NO: 7510 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7511 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7512 - protein, 2024 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 7513 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 7514 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7515 - protein, 2088 aa, synthetic construct; identical to SEQ ID NO: 7513

SEQ ID NO: 7516 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7517 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7518 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7519 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7520 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGPRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAPPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISDAGKRTADGSEFEKRTADGSEFESPKKKAKVE

SEQ ID NO: 7521 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7522 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7523 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7524 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7525 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7526 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7527 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7528 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7529 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7530 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7531 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7532 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7533 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7534 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7535 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7536 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7537 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7538 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7539 - protein, 2096 aa, synthetic construct; identical to SEQ ID NO: 7537

SEQ ID NO: 7540 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7541 - protein, 2090 aa, synthetic construct; identical to SEQ ID NO: 7540

SEQ ID NO: 7542 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7543 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7544 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7545 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7546 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7547 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7548 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7549 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7550 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7551 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7552 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7553 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7554 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7555 - protein, 2127 aa, synthetic construct; identical to SEQ ID NO: 4537

SEQ ID NO: 7556 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7557 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7558 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGFCRLFIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7559 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7560 - protein, 2096 aa, synthetic construct; identical to SEQ ID NO: 7559

SEQ ID NO: 7561 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 7562 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7563 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7564 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7565 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7566 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7567 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7568 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7569 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7570 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7571 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7572 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7573 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7574 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7575 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7576 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7577 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7578 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7579 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7580 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7581 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGKAGFCRLFIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7582 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7583 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7584 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7585 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7586 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7587 - protein, 2096 aa, synthetic construct; identical to SEQ ID NO: 4538

SEQ ID NO: 7588 - protein, 2098 aa, synthetic construct; identical to SEQ ID NO: 4539

SEQ ID NO: 7589 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7590 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7591 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7592 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7593 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7594 - protein, 2096 aa, synthetic construct; identical to SEQ ID NO: 7593

SEQ ID NO: 7595 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7596 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7597 - protein, 2090 aa, synthetic construct; identical to SEQ ID NO: 7596

SEQ ID NO: 7598 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7599 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7600 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7601 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7602 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7603 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7604 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7605 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKTGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGLLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7606 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGKAGFCRLFIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7607 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7608 - protein, 2024 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 7609 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7610 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7611 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7612 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7613 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7614 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7615 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7616 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7617 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7618 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7619 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7620 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7621 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7622 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLLAGKRTADGSEFEKRTADGSEFESPKKKAKVE

SEQ ID NO: 7623 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7624 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7625 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7626 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7627 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7628 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7629 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7630 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7631 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7632 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7633 - protein, 2127 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7634 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7635 - protein, 2218 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7636 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7637 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKTGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGLLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7638 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7639 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7640 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7641 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7642 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7643 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7644 - protein, 2096 aa, synthetic construct; identical to SEQ ID NO: 7643

SEQ ID NO: 7645 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKTGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGLLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7646 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7647 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7648 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGMNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVNAGKRTADGSEFEKRTADGSEFESPKKKAKVE

SEQ ID NO: 7649 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7650 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7651 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7652 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7653 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7654 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7655 - protein, 2162 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7656 - protein, 2253 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7657 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7658 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7659 - protein, 2131 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLLAGKRTADGSEFEKRTADGSEFESPKKKAKVE

SEQ ID NO: 7660 - protein, 2131 aa, synthetic construct; identical to SEQ ID NO: 4540

SEQ ID NO: 7661 - protein, 2151 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 7662 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7663 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7664 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7665 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7666 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7667 - protein, 2122 aa, synthetic construct; identical to SEQ ID NO: 4541

SEQ ID NO: 7668 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7669 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7670 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7671 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7672 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7673 - protein, 2017 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGAVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLAGKRTADGSEFEKRTADGSEFESPKKKAKVE

SEQ ID NO: 7674 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7675 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7676 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7677 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7678 - protein, 2120 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 7679 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7680 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7681 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7682 - protein, 2222 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7683 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7684 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7685 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7686 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGKAGFCRLFIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7687 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7688 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7689 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7690 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7691 - protein, 2100 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7692 - protein, 2011 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGPLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSPIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQSAGKRTADGSEFEKRTADGSEFESPKKKAKVE

SEQ ID NO: 7693 - protein, 2223 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7694 - protein, 2132 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7695 - protein, 2223 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7696 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7697 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7698 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7699 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7700 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKTGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGLLTSEGKEIKNKDEILALLKALFLPKRLSIIHCPGHQKGNRAEARGNRMADQAAREVATRETPETSTLLAGKRTADGSEFEKRTADGSEFESPKKKAKVE

SEQ ID NO: 7701 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 7702 - protein, 2095 aa, synthetic construct; identical to SEQ ID NO: 7701

SEQ ID NO: 7703 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7704 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7705 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7706 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7707 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7708 - protein, 2002 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPPTHPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 7709 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7710 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7711 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLPAGKRTADGSEFEKRTADGSEFESPKKKAKVE

SEQ ID NO: 7712 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGVLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKPAGKRTADGSEFEKRTADGSEFESPKKKAKVE

SEQ ID NO: 7713 - protein, 2219 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7714 - protein, 2128 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7715 - protein, 2219 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7716 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7717 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7718 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7719 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLLAGKRTADGSEFEKRTADGSEFESPKKKAKVE

SEQ ID NO: 7720 - protein, 2120 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7721 - protein, 2120 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7722 - protein, 2124 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7723 - protein, 2124 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHITAGKRTADGSEFEKRTADGSEFESPKKKAKVE

SEQ ID NO: 7724 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVHAGKRTADGSEFEKRTADGSEFESPKKKAKVE

SEQ ID NO: 7725 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7726 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNAGKRTADGSEFEKRTADGSEFESPKKKAKVE

SEQ ID NO: 7727 - protein, 2149 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7728 - protein, 2149 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKNAGKRTADGSEFEKRTADGSEFESPKKKAKVE

SEQ ID NO: 7729 - protein, 2118 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLAGKRTADGSEFEKRTADGSEFESPKKKAKVE

SEQ ID NO: 7730 - protein, 2118 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLLAGKRTADGSEFEKRTADGSEFESPKKKAKVE

SEQ ID NO: 7731 - protein, 2118 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLAGKRTADGSEFEKRTADGSEFESPKKKAKVE

SEQ ID NO: 7732 - protein, 2118 aa, synthetic construct; identical to SEQ ID NO: 7731

SEQ ID NO: 7733 - protein, 2138 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 7734 - protein, 2110 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 7735 - protein, 2110 aa, synthetic construct; identical to SEQ ID NO: 7734

SEQ ID NO: 7736 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7737 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7738 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 7739 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7740 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 7741 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7742 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7743 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGVLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKPAGKRTADGSEFEKRTADGSEFESPKKKAKVE

SEQ ID NO: 7744-8000 - skipped (257 entries)

SEQ ID NO: 8001 - protein, 673 aa, Reticuloendotheliosis virus
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATIS

SEQ ID NO: 8002 - protein, 673 aa, synthetic construct
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATIS

SEQ ID NO: 8003 - protein, 673 aa, synthetic construct
TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATIS

SEQ ID NO: 8004 - protein, 677 aa, Baboon endogenous virus
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFDEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKESTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGLLTSEGKEIKNKAEIIALLKALFLPQEVAIIHCPGHQKGQDPVAVGNRQADRVARQAAMAEVLTLATEPDNTSHIT

SEQ ID NO: 8005 - protein, 677 aa, synthetic construct
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHIT

SEQ ID NO: 8006 - protein, 677 aa, synthetic construct
TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVKKPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFNEALHRDLTDFRTQHPEVTLLQYVDDLLLAAPTKKACTQGTRHLLQELGEKGYRASAKKAQICQTKVTYLGYILSEGKRWLTPGRIETVARIPPPRNPREVREFLGKAGFCRLFIPGFAELAAPLYALTKPSTPFTWQTEHQLAFEALKKALLSAPALGLPDTSKPFTLFLDERQGIAKGVLTQKLGPWKRPVAYLSKKLDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQVLAETHGTREDLKDQELPDADHTWYTDGSSYLDSGTRRAGAAVVDGHNTIWAQSLPPGTSAQKAELIALTKALELSKGKKANIYTDSRYAFATAHTHGSIYERRGWLTSEGKEIKNKAEIIALLKALFLPQEVAIIHCPGHQKGQDPVAVGNRQADRVARQAAMAEVLTLATEPDNTSHIT

SEQ ID NO: 8007 - protein, 576 aa, Bovine leukemia virus
GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPTHLPHIICLDLKDAFFQIPVEDRFRSYFAFTLPTPGGLQPHRRFAWRVLPQGFINSPALFERALQEPLRQVSAAFSQSLLVSYMDDILYVSPTEEQRLQCYQTMAAHLRDLGFQVASEKTRQTPSPVPFLGQMVHERMVTYQSLPTLQISSPISLHQLQTVLGDLQWVSRGTPTTRRPLQLLYSSLKGIDDPRAIIHLSPEQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPKTSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELAGLLAGLAAAPPEPLNIWVDSKYLYSLLRTLVLGAWLQPDPVPSYALLYKSLLRHPAIFVGHVRSHSSASHPIASLNNYVDQL

SEQ ID NO: 8008 - protein, 576 aa, synthetic construct
GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPTHLPHIICLDLKDAFFQIPVEDRFRSYFAFTLPTPGGLQPHRRFAWRVLPQGFINSPALFQRALQEPLRQVSAAFSQSLLVSYMDDILYVSPTEEQRLQCYQTMAAHLRDLGFQVASEKTRQTPSPVPFLGQMVHERMVTYQSLPTLQISSPISLHQLQTVLGDLQWVSRGTPTTRRPLQLLYSSLKPIDDPRAIIHLSPEQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPKTSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELAGLLAGLAAAPPEPLNIWVDSKYLYSLLRTLVLGAWLQPDPVPSYALLYKSLLRHPAIFVGHVRSHSSASHPIASLNNYVDQL

SEQ ID NO: 8009 - protein, 576 aa, Bovine leukemia virus
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQL

SEQ ID NO: 8010 - protein, 576 aa, synthetic construct
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQL

SEQ ID NO: 8011 - protein, 576 aa, synthetic construct
GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPPTHPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQL

SEQ ID NO: 8012 - protein, 748 aa, Feline foamy virus
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8013 - protein, 748 aa, synthetic construct
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8014 - protein, 748 aa, synthetic construct
MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8015 - protein, 662 aa, Feline foamy virus
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8016 - protein, 662 aa, synthetic construct
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8017 - protein, 662 aa, synthetic construct
VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNRKKPLKHISKWKSVADLKRLRPDVVVTHEPGHQKLDSSPHAYGNNLADQLATQASFKVH

SEQ ID NO: 8018 - protein, 670 aa, Feline leukemia virus
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVLP

SEQ ID NO: 8019 - protein, 670 aa, synthetic construct
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLP

SEQ ID NO: 8020 - protein, 670 aa, synthetic construct
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFNEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGWLTSEGKEIKNKNEILALLEALFLPKRLSIIHCPGHQKGDSPQAKGNRLADDTAKKAATETHSSLTVLP

SEQ ID NO: 8021 - protein, 751 aa, unidentified
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8022 - protein, 751 aa, synthetic construct
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8023 - protein, 751 aa, synthetic construct
MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8024 - protein, 662 aa, unidentified
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8025 - protein, 662 aa, synthetic construct
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8026 - protein, 662 aa, synthetic construct
VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVN

SEQ ID NO: 8027 - protein, 669 aa, Gibbon ape leukemia virus
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGLLTSAGKDIKNKEEILALLEAIHLPRRVAIIHCPGHQRGSNPVATGNRRADEAAKQAALSTRVLAGTTKP

SEQ ID NO: 8028 - protein, 669 aa, synthetic construct
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKP

SEQ ID NO: 8029 - protein, 669 aa, synthetic construct
VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLLPVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSPTLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVPTTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLEDQPLPGVPTWYTDGSSFITEGKRRAGAPIVDGKRTVWASSLPEGTSAQKAELVALTQALRLAEGKNINIYTDSRYAFATAHIHGAIYKQRGWLTSAGKDIKNKEEILALLEAIHLPRRVAIIHCPGHQRGSNPVATGNRRADEAAKQAALSTRVLAGTTKP

SEQ ID NO: 8030 - protein, 588 aa, unidentified
AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 8031 - protein, 588 aa, synthetic construct
AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 8032 - protein, 588 aa, synthetic construct
AVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTIDLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 8033 - protein, 588 aa, unidentified
AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 8034 - protein, 588 aa, synthetic construct
AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTIDLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLISHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQLRQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTSDHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQL

SEQ ID NO: 8035 - protein, 583 aa, unidentified
GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFEMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLALGTFQGKSSQAPFQALLPRLLAHKVIYLHHVRSHTNLPDPISKLNALTDALLITPIL

SEQ ID NO: 8036 - protein, 583 aa, synthetic construct
GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPIL

SEQ ID NO: 8037 - protein, 583 aa, synthetic construct
GLEHLPRPPEISQFPLNPERLQALQHLVRKALEAGHIEPYTGPGNNPVFPVKKANGTWRFIHDLRATNSLTVDLSSSSPGPPDLSSPPTTLAHLQTIDLKDAFFQIPLPKQFQPYFAFTVPQQCNYGPGTRYAWKVLPQGFKNSPTLFQMQLASILQPIRQAFPQCVILQYMDDILLASPSPEDLQQLSEATMASLISHGLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQQALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSDHPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLHGLSSARSWHCLNIFLDSKYLYHYLRTLAWGTFQGKSSQAPFQALLPRLLAHKVIYLHHVRSHTNLPDPISKLNALTDALLITPIL

SEQ ID NO: 8038 - protein, 584 aa, unidentified
GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFEQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMALGAFPGPSTQCELHTQLLPLLQGKTVYVHHVRSHTLLQDPISRLNEATDALMLAPLLPL

SEQ ID NO: 8039 - protein, 584 aa, synthetic construct
GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPL

SEQ ID NO: 8040 - protein, 584 aa, synthetic construct
GLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDLTDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGLPLSPEKTQATPGPIHFLGQVISQDCITYETLPSINVKSTWSLAELQSMLGELQWVSKGTPVLRSSLHQLYLALRGHRDPRDTIKLTSIQVQALRTIQKALTLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSVAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQKSQPWVALNIFLDSKFLIGHLRRMAWGAFPGPSTQCELHTQLLPLLQGKTVYVHHVRSHTLLQDPISRLNEATDALMLAPLLPL

SEQ ID NO: 8041 - protein, 584 aa, unidentified
GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFEQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMALGAFLGPSTQCDLHARLFPLLQGKTVYVHHVRSHTLLQDPISRLNEATDALMLAPLLPL

SEQ ID NO: 8042 - protein, 584 aa, synthetic construct
GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPL

SEQ ID NO: 8043 - protein, 584 aa, synthetic construct
GLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLTDAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEGLPMSLEKTQATPGSIHFLGQVISPDCITYETLPSIHVKSIWSLAELQSMLGELQWVSKGTPVLRSSLHQLYLALRGHRDPRDTIELTSTQVQALKTIQKALALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAILLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKPWPALNIFLDSKFLIGHLRRMAWGAFLGPSTQCDLHARLFPLLQGKTVYVHHVRSHTLLQDPISRLNEATDALMLAPLLPL

SEQ ID NO: 8044 - protein, 584 aa, synthetic construct
HLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDAFFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGLPISQEKTQQTPGQIRFLGQVISPNHITYESTPTIPIKSQWTLTELQVILGEIQWVSKGTPILRKHLQSLYSALHPYRDPRACITLTPQQLHALHAIQQALQHNCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSVGILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLRAAKPWPSLNIFLDSKYLIKYLHSLAIGAFLGTSAHQTLQAALPPLLQGKTIYLHHVRSHTNLPDPISTFNEYTDSLILAPLVPL

SEQ ID NO: 8045 - protein, 581 aa, Jaagsiekte sheep retrovirus
PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQS

SEQ ID NO: 8046 - protein, 581 aa, synthetic construct
PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPTPSPIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLLYQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLEGRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWLFQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNLFTDSSYVVGALQMIETVPIIGTTSPEVLNLFTLIQQVLHCRQHPCFFGHIRAHSTLPGALVQGNHTADVLTKQVFFQS

SEQ ID NO: 8047 - protein, 793 aa, Koala retrovirus
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKN

SEQ ID NO: 8048 - protein, 793 aa, synthetic construct
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 8049 - protein, 793 aa, synthetic construct
TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 8050 - protein, 702 aa, Koala retrovirus
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTREKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTETTKN

SEQ ID NO: 8051 - protein, 702 aa, synthetic construct
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGTAGFCRLWIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 8052 - protein, 702 aa, synthetic construct
LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALYVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTETTKN

SEQ ID NO: 8053 - protein, 671 aa, unidentified
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLL

SEQ ID NO: 8054 - protein, 671 aa, synthetic construct
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 8055 - protein, 671 aa, synthetic construct
TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLLTLGNLGYRASAKKAQLCQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWARALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 8056 - protein, 671 aa, Murine leukemia virus
TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLL

SEQ ID NO: 8057 - protein, 671 aa, Murine leukemia virus; identical to SEQ ID NO: 8056

SEQ ID NO: 8058 - protein, 671 aa, synthetic construct
TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLL

SEQ ID NO: 8059 - protein, 671 aa, synthetic construct; identical to SEQ ID NO: 8058

SEQ ID NO: 8060 - protein, 671 aa, synthetic construct
LGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFNEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGWLTSEGREIKNKSEILALLKALFLPKRLSIIHCLGHQKGDSAEARGNRLADQAAREAAIKTPPDTSTLLI

SEQ ID NO: 8061 - protein, 671 aa, synthetic construct; identical to SEQ ID NO: 8060

SEQ ID NO: 8062 - protein, 671 aa, unidentified
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKTGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGLLTSEGKEIKNKDEILALLKALFLPKRLSIIHCPGHQKGNSAEARGNRMADQAAREVATRETPETSTLL

SEQ ID NO: 8063 - protein, 671 aa, synthetic construct
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLL

SEQ ID NO: 8064 - protein, 671 aa, synthetic construct
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLAGFRIQHPDLILLQYVDDLLLAATSELDCQQGTRALLQTLGDLGYRASAKKAQICQKQVKYLGYLLKEGQRWLTEARKETVMGQPIPKTPRQLREFLGKAGFCRLFIPGFAEMAAPLYPLTKPGTLFNWGPDQQKAFQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRSDLMDQPLPDADHTWYTDGSSFLQEGQRKAGAAVTTETEVIWARALPAGTSAQRAELIALTQALKMAEGKKLNVYTDSRYAFATAHIHGEIYRRRGWLTSEGKEIKNKDEILALLKALFLPKRLSIIHCPGHQKGNSAEARGNRMADQAAREVATRETPETSTLL

SEQ ID NO: 8065 - protein, 671 aa, unidentified
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGLCRLWIPGFAEMAAPLYPLTKTGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGLLTSEGKEIKNKDEILALLKALFLPKRLSIIHCPGHQKGNHAEARGNRMADQAAREVATRETPETSTLL

SEQ ID NO: 8066 - protein, 671 aa, synthetic construct
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGLCRLWIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLL

SEQ ID NO: 8067 - protein, 671 aa, synthetic construct
TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAYLSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRRAGAAVTTETEVIWAKALPAGTSAQRAELIALTQALKMAAGKKLNVYTDSRYAFATAHIHGEIYRRRGWLTSEGKEIKNKDEILALLKALFLPKRLSIIHCPGHQKGNHAEARGNRMADQAAREVATRETPETSTLL

SEQ ID NO: 8068 - protein, 671 aa, synthetic construct
TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLL

SEQ ID NO: 8069 - protein, 671 aa, synthetic construct
TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLFNEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGKAGFCRLFIPGFAEMAAPLYPLTKPGTLFEWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQHDCLDILAEAHGTRPDLTDQPLPDADHTWYTDGSSFLQEGQRKAGAAVTTETEVVWAKALPAGTSAQRAELIALTQALKMAEGKKLNVYTDSRYAFATAHIHGEIYRRRGWLTSEGKEIKNKDEILALLKALFLPKRLSIIHCPGHQKGNRAEARGNRMADQAAREVATRETPETSTLL

SEQ ID NO: 8070 - protein, 671 aa, Murine leukemia virus; identical to SEQ ID NO: 5003

SEQ ID NO: 8071 - protein, 671 aa, Murine leukemia virus; identical to SEQ ID NO: 5003

SEQ ID NO: 8072 - protein, 671 aa, synthetic construct
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLL

SEQ ID NO: 8073 - protein, 671 aa, synthetic construct; identical to SEQ ID NO: 8072

SEQ ID NO: 8074 - protein, 671 aa, synthetic construct
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLL

SEQ ID NO: 8075 - protein, 671 aa, synthetic construct; identical to SEQ ID NO: 8074

SEQ ID NO: 8076 - protein, 691 aa, synthetic construct
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFE

SEQ ID NO: 8077 - protein, 691 aa, synthetic construct; identical to SEQ ID NO: 8076

SEQ ID NO: 8078 - protein, 671 aa, unidentified
TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFDEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKTGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGLLTSEGREIKNKSEILALLKALFLPKRLSIIHCLGHQKGDSAEARGNRLADQAAREAAIKTPPDTSTLL

SEQ ID NO: 8079 - protein, 671 aa, synthetic construct
TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKPGTLFNWGPDQQKAYHEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRRGWLTSEGREIKNKSEILALLKALFLPKRLSIIHCLGHQKGDSAEARGNRLADQAAREAAIKTPPDTSTLL

SEQ ID NO: 8080 - protein, 691 aa, Mouse mammary tumor virus
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8081 - protein, 691 aa, Mouse mammary tumor virus; identical to SEQ ID NO: 8080

SEQ ID NO: 8082 - protein, 691 aa, synthetic construct
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8083 - protein, 691 aa, synthetic construct
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 8084 - protein, 691 aa, synthetic construct; identical to SEQ ID NO: 8083

SEQ ID NO: 8085 - protein, 691 aa, synthetic construct
WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8086 - protein, 691 aa, synthetic construct; identical to SEQ ID NO: 8085

SEQ ID NO: 8087 - protein, 691 aa, synthetic construct
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 8088 - protein, 691 aa, synthetic construct; identical to SEQ ID NO: 8087

SEQ ID NO: 8089 - protein, 691 aa, Mouse mammary tumor virus
VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTA

SEQ ID NO: 8090 - protein, 691 aa, Mouse mammary tumor virus; identical to SEQ ID NO: 8089

SEQ ID NO: 8091 - protein, 599 aa, Mouse mammary tumor virus
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8092 - protein, 599 aa, Mouse mammary tumor virus; identical to SEQ ID NO: 8091

SEQ ID NO: 8093 - protein, 599 aa, synthetic construct
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8094 - protein, 599 aa, synthetic construct; identical to SEQ ID NO: 8093

SEQ ID NO: 8095 - protein, 599 aa, synthetic construct
GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT

SEQ ID NO: 8096 - protein, 599 aa, synthetic construct; identical to SEQ ID NO: 8095

SEQ ID NO: 8097 - protein, 585 aa, Mason-Pfizer monkey virus
LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINT

SEQ ID NO: 8098 - protein, 585 aa, synthetic construct
LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAPPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINT

SEQ ID NO: 8099 - protein, 665 aa, unidentified
TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLL

SEQ ID NO: 8100 - protein, 665 aa, unidentified; identical to SEQ ID NO: 8099

SEQ ID NO: 8101 - protein, 665 aa, synthetic construct
TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLL

SEQ ID NO: 8102 - protein, 665 aa, synthetic construct; identical to SEQ ID NO: 8101

SEQ ID NO: 8103 - protein, 663 aa, synthetic construct
LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLP

SEQ ID NO: 8104 - protein, 663 aa, synthetic construct; identical to SEQ ID NO: 8103

SEQ ID NO: 8105 - protein, 751 aa, Macaque simian foamy virus
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8106 - protein, 751 aa, synthetic construct
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8107 - protein, 751 aa, synthetic construct
MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8108 - protein, 662 aa, Macaque simian foamy virus
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8109 - protein, 662 aa, synthetic construct
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8110 - protein, 662 aa, synthetic construct
VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVH

SEQ ID NO: 8111 - protein, 751 aa, unidentified
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8112 - protein, 751 aa, synthetic construct
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8113 - protein, 751 aa, synthetic construct
MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8114 - protein, 662 aa, unidentified
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8115 - protein, 662 aa, synthetic construct
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8116 - protein, 662 aa, synthetic construct
IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVN

SEQ ID NO: 8117 - protein, 751 aa, Simian foamy virus
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8118 - protein, 751 aa, synthetic construct
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8119 - protein, 751 aa, synthetic construct
MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8120 - protein, 662 aa, Simian foamy virus
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8121 - protein, 662 aa, synthetic construct
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8122 - protein, 662 aa, synthetic construct
VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQGFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISKWKSIAECLSIKPDITIQHEKGHQPINTSIHTEGNALADKLATQGSYVVN

SEQ ID NO: 8123 - protein, 592 aa, Squirrel monkey retrovirus
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKGDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 8124 - protein, 592 aa, synthetic construct
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 8125 - protein, 592 aa, synthetic construct
PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPVAPPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAKACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPEAKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPYTQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTVLAHQPFNLYTDSAYIAQSVPLLETVPFIKSSTNATPLFSKLQQLILNRQHPFFIGHLRAHLNLPGPLAEGNALADAATQIFPIISD

SEQ ID NO: 8126 - protein, 585 aa, unidentified
LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTT

SEQ ID NO: 8127 - protein, 585 aa, synthetic construct
LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLPSPVAPPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGEQVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRSLSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIHWLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHRALNVYTDSAYLAHSIPLLETVSHIKHISDTAKFFLQCQQLIYNRSIPFYLGHIRAHSGLPGPLSQGNHITDLATKVVATTLTT

SEQ ID NO: 8128 - protein, 650 aa, Walleye dermal sarcoma virus
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKKDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 8129 - protein, 650 aa, synthetic construct
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 8130 - protein, 650 aa, synthetic construct
SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHDLRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMDDVLIASKDRDTNLKDTAVMLQHLASEGHKVSKKKLQLCQQEVVYLGQLLTPEGRKILPDRKVTVSQFQQPTTIRQIRAFLGKVGYCRHFIPEFSIHSKFLEKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQADSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSDGSYTTGRGGAAVVMHRPVTDDFIIIHQQPGGASAQTAELLALAAACHLATDKTVNIYTDSRYAYGVVHDFGHLWMHRGFVTSAGTPIKNHKEIEYLLKQIMKPKQVSVIKIEAHTKGVSMEVRGNAAADEAAKNAVFLVQR

SEQ ID NO: 8131 - protein, 669 aa, Woolly monkey sarcoma virus
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGLLTSAGKDIKNKEEILALLEAIHLPKRVAIIHCPGHQKGNDPVATGNRRADEAAKQAALSTRVLAETTKP

SEQ ID NO: 8132 - protein, 669 aa, synthetic construct
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKP

SEQ ID NO: 8133 - protein, 669 aa, synthetic construct
VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLLPVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSPTLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPPTTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAYLSKKLDPVASGWPTCLKAVAAVALLLKDADKLTLGQNVTVIASHSLESIVRQPPDRWMTNARMTHYQSLLLNERVSFAPPAVLNPATLLPVESEATPVHRCSEILAEETGTRRDLKDQPLPGVPAWYTDGSSFIAEGKRRAGAAIVDGKRTVWASSLPEGTSAQKAELVALTQALRLAEGKDINIYTDSRYAFATAHIHGAIYKQRGWLTSAGKDIKNKEEILALLEAIHLPKRVAIIHCPGHQKGNDPVATGNRRADEAAKQAALSTRVLAETTKP

SEQ ID NO: 8134 - protein, 671 aa, unidentified
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGLLTSEGREIKNKNEILALLKALFLPKRLSIIHCPGHQKGNSAEARGNRMADQAAREAAMKAVLETSTLL

SEQ ID NO: 8135 - protein, 671 aa, synthetic construct
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLL

SEQ ID NO: 8136 - protein, 671 aa, synthetic construct
TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSEQDCQRGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEAPHDCLEILAETHGTRPDLTDQPIPDADYTWYTDGSSFLQEGQRRAGAAVTTETEVIWARALPAGTSAQRAELIALTQALKMAEGKKLNVYTDSRYAFATAHVHGEIYRRRGWLTSEGREIKNKNEILALLKALFLPKRLSIIHCPGHQKGNSAEARGNRMADQAAREAAMKAVLETSTLL

SEQ ID NO: 8137 - protein, 677 aa, unidentified
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 8138-9000 - skipped (863 entries)

SEQ ID NO: 9001 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 9002 - protein, 1055 aa, Pasteurella pneumotropica
MQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANENQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVR

SEQ ID NO: 9003 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 9004 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 9005 - protein, 1061 aa, Staphylococcus auricularis
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRQLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYYNDLIMYEDELFRVIGVNSDINNLVELNMVDITYKDFCEVNNVTGEKRIKKTIGKRVVLIEKYTTDILGNLYKTPLPKKPQLIFKRGEL

SEQ ID NO: 9006 - protein, 1061 aa, Staphylococcus auricularis
MQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRKLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYKNDLIMYEDELFRVIGVNSDINNLVELNMVDITYKDFCEVNNVTGEKHIKKTIGKRVVLIEKYTTDILGNLYKTPLPKKPQLIFKRGEL

SEQ ID NO: 9007 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 9008 - protein, 1368 aa, Streptococcus pyogenes [sequence omitted]

SEQ ID NO: 9009 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 9010 - protein, 1368 aa, Streptococcus pyogenes
MDKKYSIGLDIGTNSVGWAVITDEYKVPSKKFKVLGNTDRHSIKKNLIGALLFDSGETAERTRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTRLGAPRAFKYFDTTIDPKQYRSTKEVLDATLIHQSITGLYETRIDLSQLGGD

SEQ ID NO: 9011 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 9012 - protein, 1092 aa, Brevibacillus laterosporus
MAYTMGIDVGIASCGWAIVDLERQRIIDIGVRTFEKAENPKNGEALAVPRREARSSRRRLRRKKHRIERLKHMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRSSLLVEIHTLFETQRQHHNSLASKDFELEYVNIWSAQRPVATKDQIEKMIGTCTFLPKEKRAPKASWHFQYFMLLQTINHIRITNVQGTRSLNKEEIEQVVNMALTKSKVSYHDTRKILDLSEEYQFVGLDYGKEDEKKKVESKETIIKLDDYHKLNKIFNEVELAKGETWEADDYDTVAYALTFFKDDEDIRDYLQNKYKDSKNRLVKNLANKEYTNELIGKVSTLSFRKVGHLSLKALRKIIPFLEQGMTYDKACQAAGFDFQGISKKKRSVVLPVIDQISNPVVNRALTQTRKVINALIKKYGSPETIHIETARELSKTFDERKNITKDYKENRDKNEHAKKHLSELGIINPTGLDIVKYKLWCEQQGRCMYSNQPISFERLKESGYTEVDHIIPYSRSMNDSYNNRVLVMTRENREKGNQTPFEYMGNDTQRWYEFEQRVTTNPQIKKEKRQNLLLKGFTNRRELEMLERNLNDTRYITKYLSHFISTNLEFSPSDKKKKVVNTSGRITSHLRSRWGLEKNRGQNDLHHAMDAIVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNVKKAFSTDLHKPKKDGTKGPLIKSVRIMENKTLVHPVNKGKGVVYNSSIVRTDVFQRKEKYYLLPVYVTDVTKGKLPNKVIVAKKGYHDWIEVDDSFTFLFSLYPNDLIFIRQNPKKKISLKKRIESHSISDSKEVQEIHAYYKGVDSSTAAIEFIIHDGSYYAKGVGVQNLDCFEKYQVDILGNYFKVKGEKRLELETSDSNHKGKDVNSIKSTSR

SEQ ID NO: 9013 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDKNNLIEVNMIDITYREYLENMNDKRPPHIIKTIASKTQSIKKYSTDILGNLYEVKSKKHPQIIKKG

SEQ ID NO: 9014 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNSTRNIVELNMIDITYREYLENMNDKRPPHIIKTIASKTQSIKKYSTDILGNLYEVKSKKHPQIIKKG

SEQ ID NO: 9015 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNSDDRNIIELNMIDITYREYLENMNDKRPPHIIKTIASKTQSIKKYSTDILGNLYEVKSKKHPQIIKKG

SEQ ID NO: 9016 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNNRLNKIELNMIDITYREYLENMNDKRPPHIIKTIASKTQSIKKYSTDILGNLYEVKSKKHPQIIKKG

SEQ ID NO: 9017 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 9018 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 9019 - protein, 1087 aa, Geobacillus stearothermophilus
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 9020 - protein, 1378 aa, Streptococcus sp.
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRKLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLKREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGEDSGGSGGSKRTADGSEFES

SEQ ID NO: 9021 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 9022 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 9023 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNANFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 9024 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGD

SEQ ID NO: 9025 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGD

SEQ ID NO: 9026 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTINRKQYNTTKEVLDATLIRQSITGLYETRIDLSQLGGD

SEQ ID NO: 9027 - protein, 1368 aa, Streptococcus pyogenes [sequence omitted]

SEQ ID NO: 9028 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADAQLDKVLSAYNKHRDKPIREQAENIIHLFTLTNLGAPAAFKYFDTTFKQKQYRSTKEVLDATLIHQSITGLYETRIDLSQLGGD

SEQ ID NO: 9029 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 9030 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 9031 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 9032 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9033 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 9034 - protein, 1122 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 9035 - protein, 1122 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 9036 - protein, 1120 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVAKGGQCIKGLGKSNISIYKVRTDVLGNQHIIKNEGDKPKLDF

SEQ ID NO: 9037 - protein, 1120 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVVKGGRCIKGLGKSNISIYKVRTDVLGNQHIIKNEGDKPKLDF

SEQ ID NO: 9038 - protein, 1057 aa, Staphylococcus sp.
MNQKFILGLDIGITSVGYGLIDYETKNIIDAGVRLFPEANVENNEGRRSKRGSRRLKRRRIHRLERVKLLLTEYDLINKEQIPTSNNPYQIRVKGLSEILSKDELAIALLHLAKRRGIHNVDVAADKEETASDSLSTKDQINKNAKFLESRYVCELQKERLENEGHVRGVENRFLTKDIVREAKKIIDTQMQYYPEIDETFKEKYISLVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPEFTSFKLFHDLKKVVKDHAILDDIDLLNQIAEILTIYQDKDSIVAELGQLEYLMSEADKQSISELTGYTGTHSLSLKCMNMIIDELWHSSMNQMEVFTYLNMRPKKYELKGYQRIPTDMIDDAILSPVVKRTFIQSINVINKVIEKYGIPEDIIIELARENNSDDRKKFINNLQKKNEATRKRINEIIGQTGNQNAKRIVEKIRLHDQQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIETKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKNYRFDVYLTEKGYKFVTIAYLNVFKKDNYYYIPKDKYQELKEKKKIKDTDQFIASFYKNDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 9039 - protein, 1057 aa, Staphylococcus sp.
MNQKFILGLDIGITSVGYGLIDYETKNIIDAGVRLFPEANVENNEGRRSKRGSRRLKRRRIHRLERVKLLLTEYDLINKEQIPTSNNPYQIRVKGLSEILSKDELAIALLHLAKRRGIHNVDVAADKEETASDSLSTKDQINKNAKFLESRYVCELQKERLENEGHVRGVENRFLTKDIVREAKKIIDTQMQYYPEIDETFKEKYISLVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPEFTSFKLFHDLKKVVKDHAILDDIDLLNQIAEILTIYQDKDSIVAELGQLEYLMSEADKQSISELTGYTGTHSLSLKCMNMIIDELWHSSMNQMEVFTYLNMRPKKYELKGYQRIPTDMIDDAILSPVVKRTFIQSINVINKVIEKYGIPEDIIIELARENNSDDRKKFINNLQKKNEATRKRINEIIGQTGNQNAKRIVEKIRLHDQQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTSYLKAYFSANNMDVKVKTINGSFTNHLRKVWRFDKYRNHGYKHHAEDALIIANADFLFKENKKLQNTNKILEKPTIENNTKKVTVEKEEDYNNVFETPKLVEDIKQYRDYKFSHRVDKKPNRQLINDTLYSTRMKDEHDYIVQTITDIYGKDNTNLKKQFNKNPEKFLMYQNDPKTFEKLSIIMKQYSDEKNPLAKYYEETGEYLTKYSKKNNGPIVKKIKLLGNKVGNHLDVTNKYENSTKKLVKLSIKNYRFDVYLTEKGYKFVTIAYLNVFKKDNYYYIPKDKYQELKEKKKIKDTDQFIASFYKNDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 9040-10050 - skipped (1011 entries)

SEQ ID NO: 10051 - DNA, 24 bp, synthetic construct
  source 1..24: mol_type = other DNA
gttgtagctccctttctcatttcg

SEQ ID NO: 10052 - DNA, 25 bp, synthetic construct
  source 1..25: mol_type = other DNA
gttgtagctccctttttcatttcgc

SEQ ID NO: 10053 - DNA, 14 bp, synthetic construct
  source 1..14: mol_type = other DNA
gttttagtactctg

SEQ ID NO: 10054 - DNA, 14 bp, synthetic construct
  source 1..14: mol_type = other DNA
gttttagtactctg

SEQ ID NO: 10055 - DNA, 14 bp, synthetic construct
  source 1..14: mol_type = other DNA
gttttagtactctg

SEQ ID NO: 10056 - DNA, 14 bp, synthetic construct
  source 1..14: mol_type = other DNA
gttttagtactctg

SEQ ID NO: 10057 - DNA, 12 bp, synthetic construct
  source 1..12: mol_type = other DNA
gttttagagcta

SEQ ID NO: 10058 - DNA, 12 bp, synthetic construct
  source 1..12: mol_type = other DNA
gttttagagcta

SEQ ID NO: 10059 - DNA, 12 bp, synthetic construct
  source 1..12: mol_type = other DNA
gttttagagcta

SEQ ID NO: 10060 - DNA, 12 bp, synthetic construct
  source 1..12: mol_type = other DNA
gttttagagcta

SEQ ID NO: 10061 - DNA, 14 bp, synthetic construct
  source 1..14: mol_type = other DNA
gtctttgtactctg

SEQ ID NO: 10062 - DNA, 16 bp, synthetic construct
  source 1..16: mol_type = other DNA
gctatagttccttact

SEQ ID NO: 10063 - DNA, 14 bp, synthetic construct
  source 1..14: mol_type = other DNA
gtcttagtactctg

SEQ ID NO: 10064 - DNA, 14 bp, synthetic construct
  source 1..14: mol_type = other DNA
gtcttagtactctg

SEQ ID NO: 10065 - DNA, 14 bp, synthetic construct
  source 1..14: mol_type = other DNA
gtcttagtactctg

SEQ ID NO: 10066 - DNA, 14 bp, synthetic construct
  source 1..14: mol_type = other DNA
gtcttagtactctg

SEQ ID NO: 10067 - DNA, 12 bp, synthetic construct
  source 1..12: mol_type = other DNA
actggggttcag

SEQ ID NO: 10068 - DNA, 12 bp, synthetic construct
  source 1..12: mol_type = other DNA
gttttagtccct

SEQ ID NO: 10069 - DNA, 16 bp, synthetic construct
  source 1..16: mol_type = other DNA
gtcatagttcccctga

SEQ ID NO: 10070 - DNA, 12 bp, synthetic construct
  source 1..12: mol_type = other DNA
gttttagagcta

SEQ ID NO: 10071 - DNA, 24 bp, synthetic construct
  source 1..24: mol_type = other DNA
gttgtagctccctttctcatttcg

SEQ ID NO: 10072 - DNA, 12 bp, synthetic construct
  source 1..12: mol_type = other DNA
gttttagagcta

SEQ ID NO: 10073 - DNA, 12 bp, synthetic construct
  source 1..12: mol_type = other DNA
gttttagagcta

SEQ ID NO: 10074 - DNA, 17 bp, synthetic construct
  source 1..17: mol_type = other DNA
gtttaagagctatgctg

SEQ ID NO: 10075 - DNA, 17 bp, synthetic construct
  source 1..17: mol_type = other DNA
gtttaagagctatgctg

SEQ ID NO: 10076 - DNA, 17 bp, synthetic construct
  source 1..17: mol_type = other DNA
gtttaagagctatgctg

SEQ ID NO: 10077 - DNA, 12 bp, synthetic construct
  source 1..12: mol_type = other DNA
gttttagagcta

SEQ ID NO: 10078 - DNA, 12 bp, synthetic construct
  source 1..12: mol_type = other DNA
gttttagagcta

SEQ ID NO: 10079 - DNA, 12 bp, synthetic construct
  source 1..12: mol_type = other DNA
gttttagagcta

SEQ ID NO: 10080 - DNA, 12 bp, synthetic construct
  source 1..12: mol_type = other DNA
gttttagagcta

SEQ ID NO: 10081 - DNA, 12 bp, synthetic construct
  source 1..12: mol_type = other DNA
gttttagagcta

SEQ ID NO: 10082 - DNA, 17 bp, synthetic construct
  source 1..17: mol_type = other DNA
gtttaagagctatgctg

SEQ ID NO: 10083 - DNA, 17 bp, synthetic construct
  source 1..17: mol_type = other DNA
gtttaagagctatgctg

SEQ ID NO: 10084 - DNA, 14 bp, synthetic construct
  source 1..14: mol_type = other DNA
gtctttgtactctg

SEQ ID NO: 10085 - DNA, 14 bp, synthetic construct
  source 1..14: mol_type = other DNA
gtctttgtactctg

SEQ ID NO: 10086 - DNA, 14 bp, synthetic construct
  source 1..14: mol_type = other DNA
gtctttgtactctg

SEQ ID NO: 10087 - DNA, 14 bp, synthetic construct
  source 1..14: mol_type = other DNA
gtctttgtactctg

SEQ ID NO: 10088 - DNA, 14 bp, synthetic construct
  source 1..14: mol_type = other DNA
gttttagtactctg

SEQ ID NO: 10089 - DNA, 14 bp, synthetic construct
  source 1..14: mol_type = other DNA
gttttagtactctg

SEQ ID NO: 10090-10150 - skipped (61 entries)

SEQ ID NO: 10151 - DNA, 93 bp, synthetic construct
  source 1..93: mol_type = other DNA
cgaaatgagaaccgttgctacaataaggccgtctgaaaagatgtgccgcaacgctctgccccttaaagcttctgctttaaggggcatcgttta

SEQ ID NO: 10152 - DNA, 82 bp, synthetic construct
  source 1..82: mol_type = other DNA
gcgaaatgaaaaacgttgttacaataagagatgaatttctcgcaaagctctgcctcttgaaatttcggtttcaagaggcatc

SEQ ID NO: 10153 - DNA, 58 bp, synthetic construct
  source 1..58: mol_type = other DNA
cagaatctactaaaacaaggcaaaatgccgtgtttatctcgtcaacttgttggcgaga

SEQ ID NO: 10154 - DNA, 58 bp, synthetic construct; identical to SEQ ID NO: 10153
  source 1..58: mol_type = other DNA

SEQ ID NO: 10155 - DNA, 58 bp, synthetic construct; identical to SEQ ID NO: 10153
  source 1..58: mol_type = other DNA

SEQ ID NO: 10156 - DNA, 58 bp, synthetic construct; identical to SEQ ID NO: 10153
  source 1..58: mol_type = other DNA

SEQ ID NO: 10157 - DNA, 60 bp, synthetic construct
  source 1..60: mol_type = other DNA
tagcaagttaaaataaggctagtccgttatcaacttgaaaaagtggcaccgagtcggtgc

SEQ ID NO: 10158 - DNA, 60 bp, synthetic construct; identical to SEQ ID NO: 10157
  source 1..60: mol_type = other DNA

SEQ ID NO: 10159 - DNA, 60 bp, synthetic construct; identical to SEQ ID NO: 10157
  source 1..60: mol_type = other DNA

SEQ ID NO: 10160 - DNA, 60 bp, synthetic construct; identical to SEQ ID NO: 10157
  source 1..60: mol_type = other DNA

SEQ ID NO: 10161 - DNA, 66 bp, synthetic construct
  source 1..66: mol_type = other DNA
cagaagctacaaagataaggcttcatgccgaaatcaacaccctgtcattttatggcagggtgtttt

SEQ ID NO: 10162 - DNA, 127 bp, synthetic construct
  source 1..127: mol_type = other DNA
ggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 10163 - DNA, 58 bp, synthetic construct
  source 1..58: mol_type = other DNA
cagaatctactaagacaaggcaaaatgccgtgtttatctcgtcaacttgttggcgaga

SEQ ID NO: 10164 - DNA, 58 bp, synthetic construct; identical to SEQ ID NO: 10163
  source 1..58: mol_type = other DNA

SEQ ID NO: 10165 - DNA, 58 bp, synthetic construct; identical to SEQ ID NO: 10163
  source 1..58: mol_type = other DNA

SEQ ID NO: 10166 - DNA, 58 bp, synthetic construct; identical to SEQ ID NO: 10163
  source 1..58: mol_type = other DNA

SEQ ID NO: 10167 - DNA, 76 bp, synthetic construct
  source 1..76: mol_type = other DNA
ctgaacctcagtaagcattggctcgtttccaatgttgattgctccgccggtgctccttatttttaagggcgccggc

SEQ ID NO: 10168 - DNA, 57 bp, synthetic construct
  source 1..57: mol_type = other DNA
agggactaaaataaagagtttgcgggactctgcggggttacaatcccctaaaaccgc

SEQ ID NO: 10169 - DNA, 98 bp, synthetic construct
  source 1..98: mol_type = other DNA
tcagggttactatgataagggctttctgcctaaggcagactgacccgcggcgttggggatcgcctgtcgcccgcttttggcgggcattccccatcctt

SEQ ID NO: 10170 - DNA, 60 bp, synthetic construct; identical to SEQ ID NO: 10157
  source 1..60: mol_type = other DNA

SEQ ID NO: 10171 - DNA, 93 bp, synthetic construct; identical to SEQ ID NO: 10151
  source 1..93: mol_type = other DNA

SEQ ID NO: 10172 - DNA, 60 bp, synthetic construct; identical to SEQ ID NO: 10157
  source 1..60: mol_type = other DNA

SEQ ID NO: 10173 - DNA, 60 bp, synthetic construct; identical to SEQ ID NO: 10157
  source 1..60: mol_type = other DNA

SEQ ID NO: 10174 - DNA, 65 bp, synthetic construct
  source 1..65: mol_type = other DNA
cagcatagcaagtttaaataaggctagtccgttatcaacttgaaaaagtggcaccgagtcggtgc

SEQ ID NO: 10175 - DNA, 65 bp, synthetic construct; identical to SEQ ID NO: 10174
  source 1..65: mol_type = other DNA

SEQ ID NO: 10176 - DNA, 65 bp, synthetic construct; identical to SEQ ID NO: 10174
  source 1..65: mol_type = other DNA

SEQ ID NO: 10177 - DNA, 60 bp, synthetic construct; identical to SEQ ID NO: 10157
  source 1..60: mol_type = other DNA

SEQ ID NO: 10178 - DNA, 60 bp, synthetic construct; identical to SEQ ID NO: 10157
  source 1..60: mol_type = other DNA

SEQ ID NO: 10179 - DNA, 60 bp, synthetic construct; identical to SEQ ID NO: 10157
  source 1..60: mol_type = other DNA

SEQ ID NO: 10180 - DNA, 60 bp, synthetic construct; identical to SEQ ID NO: 10157
  source 1..60: mol_type = other DNA

SEQ ID NO: 10181 - DNA, 60 bp, synthetic construct; identical to SEQ ID NO: 10157
  source 1..60: mol_type = other DNA

SEQ ID NO: 10182 - DNA, 65 bp, synthetic construct; identical to SEQ ID NO: 10174
  source 1..65: mol_type = other DNA

SEQ ID NO: 10183 - DNA, 65 bp, synthetic construct; identical to SEQ ID NO: 10174
  source 1..65: mol_type = other DNA

SEQ ID NO: 10184 - DNA, 66 bp, synthetic construct; identical to SEQ ID NO: 10161
  source 1..66: mol_type = other DNA

SEQ ID NO: 10185 - DNA, 66 bp, synthetic construct; identical to SEQ ID NO: 10161
  source 1..66: mol_type = other DNA

SEQ ID NO: 10186 - DNA, 66 bp, synthetic construct; identical to SEQ ID NO: 10161
  source 1..66: mol_type = other DNA

SEQ ID NO: 10187 - DNA, 66 bp, synthetic construct; identical to SEQ ID NO: 10161
  source 1..66: mol_type = other DNA

SEQ ID NO: 10188 - DNA, 62 bp, synthetic construct
  source 1..62: mol_type = other DNA
cagaatctactgaaacaagacaatatgtcgtgtttatcccatcaatttattggtgggatttt

SEQ ID NO: 10189 - DNA, 62 bp, synthetic construct; identical to SEQ ID NO: 10188
  source 1..62: mol_type = other DNA

SEQ ID NO: 10190-10192 - skipped (3 entries)

SEQ ID NO: 10193 - DNA, 68 bp, synthetic construct
  source 1..68: mol_type = other DNA
tagcaagttaaaataaggctagtccgttatcaacttggacttcggtccaagtggcaccgagtcggtgc

SEQ ID NO: 10194 - DNA, 68 bp, synthetic construct
  source 1..68: mol_type = other DNA
tagcaagttaaaataaggctagtccgttatcaacttggagcttgctccaagtggcaccgagtcggtgc

SEQ ID NO: 10195 - DNA, 76 bp, synthetic construct
  source 1..76: mol_type = other DNA
gttttagagctagaaatagcaagttaaaataaggctagtccgttatcgacttgaaaaagtcgcaccgagtcggtgc

SEQ ID NO: 10196-11000 - skipped (805 entries)

SEQ ID NO: 11001 - protein, 1367 aa, unidentified
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 11002-11003 - skipped (2 entries)

SEQ ID NO: 11004 - DNA, 62 bp, synthetic construct
  source 1..62: mol_type = other DNA
cactcctccccatcctctccctctgtccctctgtccctctgaccctgcactgtcccagcacc

SEQ ID NO: 11005 - DNA, 122 bp, synthetic construct
  source 1..122: mol_type = other DNA
caggacacagccttggatcaggacagagacttgggggccatcctgcccctccaacccgacatgtgtacctcagctttttccctcacttgcatcaataaagcttctgtgtttggaacagctaa

SEQ ID NO: 11006 - RNA, 47 nt, synthetic construct
  source 1..47: mol_type = other RNA
gggaaataagagagaaaagaagagtaagaagaaatataagagccacc

SEQ ID NO: 11007 - RNA, 110 nt, synthetic construct
  source 1..110: mol_type = other RNA
tgataataggctggagcctcggtggccatgcttcttgccccttgggcctccccccagcccctcctccccttcctgcacccgtacccccgtggtctttgaataaagtctga

SEQ ID NO: 11008 - RNA, 47 nt, synthetic construct; identical to SEQ ID NO: 11006
  source 1..47: mol_type = other RNA

SEQ ID NO: 11009 - RNA, 110 nt, synthetic construct; identical to SEQ ID NO: 11007
  source 1..110: mol_type = other RNA

SEQ ID NO: 11010-11094 - skipped (85 entries)

SEQ ID NO: 11095 - protein, 9 aa, synthetic construct
PAAKRVKLD

SEQ ID NO: 11096 - protein, 1367 aa, synthetic construct
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 11097 - protein, 10 aa, synthetic construct
KRTADGSEFE

SEQ ID NO: 11098 - protein, 19 aa, synthetic construct
KRTADGSEFESPKKKAKVE

SEQ ID NO: 11099 - protein, 29 aa, synthetic construct
KRTADGSEFEKRTADGSEFESPKKKAKVE

SEQ ID NO: 11100-12000 - skipped (901 entries)

SEQ ID NO: 12001 - protein, 8 aa, synthetic construct
EAAAKGSS

SEQ ID NO: 12002 - protein, 20 aa, synthetic construct
EAAAKEAAAKEAAAKEAAAK

SEQ ID NO: 12003 - protein, 8 aa, synthetic construct
PAPEAAAK

SEQ ID NO: 12004 - protein, 11 aa, synthetic construct
EAAAKPAPGGG

SEQ ID NO: 12005 - protein, 18 aa, synthetic construct
GSSGSSGSSGSSGSSGSS

SEQ ID NO: 12006 - protein, 11 aa, synthetic construct
PAPGGGEAAAK

SEQ ID NO: 12007 - protein, 46 aa, synthetic construct; identical to SEQ ID NO: 5217

SEQ ID NO: 12008 - protein, 8 aa, synthetic construct
GSSEAAAK

SEQ ID NO: 12009 - protein, 11 aa, synthetic construct
EAAAKPAPGGS

SEQ ID NO: 12010 - protein, 18 aa, synthetic construct
GGSGGSGGSGGSGGSGGS

SEQ ID NO: 12011 - protein, 46 aa, synthetic construct; identical to SEQ ID NO: 5217

SEQ ID NO: 12012 - protein, 46 aa, synthetic construct; identical to SEQ ID NO: 5217

SEQ ID NO: 12013 - protein, 15 aa, synthetic construct
EAAAKEAAAKEAAAK

SEQ ID NO: 12014 - protein, 11 aa, synthetic construct
PAPEAAAKGSS

SEQ ID NO: 12015 - protein, 46 aa, synthetic construct; identical to SEQ ID NO: 5217

SEQ ID NO: 12016 - protein, 15 aa, synthetic construct
EAAAKEAAAKEAAAK

SEQ ID NO: 12017 - protein, 46 aa, synthetic construct; identical to SEQ ID NO: 5217

SEQ ID NO: 12018 - protein, 11 aa, synthetic construct
PAPAPAPAPAP

SEQ ID NO: 12019 - protein, 11 aa, synthetic construct
PAPAPAPAPAP

SEQ ID NO: 12020 - protein, 11 aa, synthetic construct
EAAAKGGSPAP

SEQ ID NO: 12021 - skipped

SEQ ID NO: 12022 - protein, 9 aa, synthetic construct
PAPGGGGSS

SEQ ID NO: 12023 - protein, 16 aa, synthetic construct
SGSETPGTSESATPES

SEQ ID NO: 12024 - protein, 11 aa, synthetic construct
PAPEAAAKGSS

SEQ ID NO: 12025 - protein, 11 aa, synthetic construct
EAAAKGGSGGG

SEQ ID NO: 12026 - protein, 10 aa, synthetic construct
GGGGSGGGGS

SEQ ID NO: 12027 - protein, 9 aa, synthetic construct
GGGPAPGSS

SEQ ID NO: 12028 - protein, 18 aa, synthetic construct
GGSGGSGGSGGSGGSGGS

SEQ ID NO: 12029 - protein, 30 aa, synthetic construct; identical to SEQ ID NO: 5112

SEQ ID NO: 12030 - protein, 6 aa, synthetic construct
GSSPAP

SEQ ID NO: 12031 - protein, 11 aa, synthetic construct
EAAAKGSSPAP

SEQ ID NO: 12032 - protein, 11 aa, synthetic construct
GSSGGGEAAAK

SEQ ID NO: 12033 - protein, 18 aa, synthetic construct
GGSGGSGGSGGSGGSGGS

SEQ ID NO: 12034 - protein, 9 aa, synthetic construct
PAPAPAPAP

SEQ ID NO: 12035 - protein, 20 aa, synthetic construct
EAAAKEAAAKEAAAKEAAAK

SEQ ID NO: 12036 - protein, 11 aa, synthetic construct
EAAAKGGSPAP

SEQ ID NO: 12037 - protein, 11 aa, synthetic construct
PAPGGSEAAAK

SEQ ID NO: 12038 - protein, 30 aa, synthetic construct; identical to SEQ ID NO: 5112

SEQ ID NO: 12039 - protein, 15 aa, synthetic construct
EAAAKGGGGSEAAAK

SEQ ID NO: 12040 - protein, 46 aa, synthetic construct; identical to SEQ ID NO: 5217

SEQ ID NO: 12041 - skipped

SEQ ID NO: 12042 - protein, 12 aa, synthetic construct
GSSGSSGSSGSS

SEQ ID NO: 12043 - protein, 11 aa, synthetic construct
GSSPAPEAAAK

SEQ ID NO: 12044 - protein, 11 aa, synthetic construct
GGSPAPEAAAK

SEQ ID NO: 12045 - protein, 11 aa, synthetic construct
GGGEAAAKGGS

SEQ ID NO: 12046 - protein, 25 aa, synthetic construct
EAAAKEAAAKEAAAKEAAAKEAAAK

SEQ ID NO: 12047 - protein, 8 aa, synthetic construct
GGGGGGGG

SEQ ID NO: 12048 - protein, 6 aa, synthetic construct
GGGPAP

SEQ ID NO: 12049 - protein, 13 aa, synthetic construct
PAPAPAPAPAPAP

SEQ ID NO: 12050 - protein, 18 aa, synthetic construct
GGSGGSGGSGGSGGSGGS

SEQ ID NO: 12051 - skipped

SEQ ID NO: 12052 - protein, 18 aa, synthetic construct
GGSGGSGGSGGSGGSGGS

SEQ ID NO: 12053 - protein, 13 aa, synthetic construct
PAPAPAPAPAPAP

SEQ ID NO: 12054 - protein, 11 aa, synthetic construct
EAAAKPAPGSS

SEQ ID NO: 12055 - protein, 20 aa, synthetic construct
EAAAKEAAAKEAAAKEAAAK

SEQ ID NO: 12056 - protein, 8 aa, synthetic construct
EAAAKGGS

SEQ ID NO: 12057 - protein, 15 aa, synthetic construct
GGGGSEAAAKGGGGS

SEQ ID NO: 12058 - protein, 11 aa, synthetic construct
EAAAKPAPGSS

SEQ ID NO: 12059 - protein, 20 aa, synthetic construct
GGGGSGGGGSGGGGSGGGGS

SEQ ID NO: 12060 - protein, 11 aa, synthetic construct
EAAAKGGGGGS

SEQ ID NO: 12061 - protein, 6 aa, synthetic construct
GGSPAP

SEQ ID NO: 12062 - protein, 11 aa, synthetic construct
EAAAKGGGPAP

SEQ ID NO: 12063 - protein, 25 aa, synthetic construct
EAAAKEAAAKEAAAKEAAAKEAAAK

SEQ ID NO: 12064 - skipped

SEQ ID NO: 12065 - protein, 5 aa, synthetic construct
EAAAK

SEQ ID NO: 12066 - protein, 9 aa, synthetic construct
GGSGSSPAP

SEQ ID NO: 12067 - protein, 18 aa, synthetic construct
GSSGSSGSSGSSGSSGSS

SEQ ID NO: 12068 - protein, 11 aa, synthetic construct
GSSEAAAKGGG

SEQ ID NO: 12069 - protein, 11 aa, synthetic construct
GGGEAAAKGGS

SEQ ID NO: 12070 - protein, 15 aa, synthetic construct
EAAAKGGGGSEAAAK

SEQ ID NO: 12071 - protein, 15 aa, synthetic construct
GGGGSGGGGSGGGGS

SEQ ID NO: 12072 - protein, 20 aa, synthetic construct
GGGGSGGGGSGGGGSGGGGS

SEQ ID NO: 12073 - protein, 16 aa, synthetic construct
SGSETPGTSESATPES

SEQ ID NO: 12074 - protein, 11 aa, synthetic construct
GGGEAAAKPAP

SEQ ID NO: 12075 - protein, 11 aa, synthetic construct
EAAAKGSSGGG

SEQ ID NO: 12076 - protein, 25 aa, synthetic construct
EAAAKEAAAKEAAAKEAAAKEAAAK

SEQ ID NO: 12077 - protein, 12 aa, synthetic construct
GGSGGSGGSGGS

SEQ ID NO: 12078 - protein, 11 aa, synthetic construct
GGSEAAAKPAP

SEQ ID NO: 12079 - protein, 11 aa, synthetic construct
EAAAKGSSGGG

SEQ ID NO: 12080 - protein, 5 aa, synthetic construct
GGGGS

SEQ ID NO: 12081 - protein, 11 aa, synthetic construct
GGGEAAAKGSS

SEQ ID NO: 12082 - protein, 13 aa, synthetic construct
PAPAPAPAPAPAP

SEQ ID NO: 12083 - protein, 20 aa, synthetic construct
GGGGSGGGGSGGGGSGGGGS

SEQ ID NO: 12084 - protein, 11 aa, synthetic construct
GGGEAAAKGSS

SEQ ID NO: 12085 - protein, 9 aa, synthetic construct
PAPGGSGSS

SEQ ID NO: 12086 - protein, 12 aa, synthetic construct
GSAGSAAGSGEF

SEQ ID NO: 12087 - protein, 11 aa, synthetic construct
PAPGGSEAAAK

SEQ ID NO: 12088 - protein, 6 aa, synthetic construct
GGSGSS

SEQ ID NO: 12089 - protein, 9 aa, synthetic construct
PAPGGGGSS

SEQ ID NO: 12090 - protein, 9 aa, synthetic construct
GSSGSSGSS

SEQ ID NO: 12091 - protein, 46 aa, synthetic construct; identical to SEQ ID NO: 5217

SEQ ID NO: 12092 - protein, 5 aa, synthetic construct
EAAAK

SEQ ID NO: 12093 - protein, 12 aa, synthetic construct
GSSGSSGSSGSS

SEQ ID NO: 12094 - protein, 9 aa, synthetic construct
PAPGGGGSS

SEQ ID NO: 12095 - protein, 11 aa, synthetic construct
GGGEAAAKGGS

SEQ ID NO: 12096 - protein, 11 aa, synthetic construct
PAPGGGEAAAK

SEQ ID NO: 12097 - protein, 9 aa, synthetic construct
GGGGGSPAP

SEQ ID NO: 12098 - protein, 8 aa, synthetic construct
EAAAKGGS

SEQ ID NO: 12099 - protein, 11 aa, synthetic construct
EAAAKGSSPAP

SEQ ID NO: 12100 - protein, 8 aa, synthetic construct
PAPEAAAK

SEQ ID NO: 12101 - protein, 12 aa, synthetic construct
GGSGGSGGSGGS

SEQ ID NO: 12102 - protein, 9 aa, synthetic construct
GGGPAPGGS

SEQ ID NO: 12103 - protein, 12 aa, synthetic construct
GSSGSSGSSGSS

SEQ ID NO: 12104 - protein, 11 aa, synthetic construct
EAAAKPAPGGS

SEQ ID NO: 12105 - protein, 6 aa, synthetic construct
GSSGSS

SEQ ID NO: 12106 - protein, 20 aa, synthetic construct
EAAAKEAAAKEAAAKEAAAK

SEQ ID NO: 12107 - protein, 20 aa, synthetic construct
EAAAKEAAAKEAAAKEAAAK

SEQ ID NO: 12108 - skipped

SEQ ID NO: 12109 - protein, 10 aa, synthetic construct
EAAAKEAAAK

SEQ ID NO: 12110 - protein, 11 aa, synthetic construct
PAPEAAAKGGG

SEQ ID NO: 12111 - protein, 11 aa, synthetic construct
GGSGSSEAAAK

SEQ ID NO: 12112 - protein, 25 aa, synthetic construct
EAAAKEAAAKEAAAKEAAAKEAAAK

SEQ ID NO: 12113 - protein, 11 aa, synthetic construct
GSSEAAAKPAP

SEQ ID NO: 12114 - protein, 25 aa, synthetic construct
EAAAKEAAAKEAAAKEAAAKEAAAK

SEQ ID NO: 12115 - protein, 8 aa, synthetic construct
EAAAKGGG

SEQ ID NO: 12116 - protein, 9 aa, synthetic construct
GSSPAPGGG

SEQ ID NO: 12117 - protein, 9 aa, synthetic construct
GGGPAPGSS

SEQ ID NO: 12118 - protein, 6 aa, synthetic construct
GGGGGS

SEQ ID NO: 12119 - protein, 30 aa, synthetic construct; identical to SEQ ID NO: 5130

SEQ ID NO: 12120 - protein, 25 aa, synthetic construct
GGGGSGGGGSGGGGSGGGGSGGGGS

SEQ ID NO: 12121 - protein, 15 aa, synthetic construct
EAAAKEAAAKEAAAK

SEQ ID NO: 12122 - protein, 9 aa, synthetic construct
PAPAPAPAP

SEQ ID NO: 12123 - protein, 15 aa, synthetic construct
GSSGSSGSSGSSGSS

SEQ ID NO: 12124 - protein, 11 aa, synthetic construct
GGGGSSEAAAK

SEQ ID NO: 12125 - protein, 12 aa, synthetic construct
GGSGGSGGSGGS

SEQ ID NO: 12126 - protein, 11 aa, synthetic construct
PAPEAAAKGGS

SEQ ID NO: 12127 - protein, 30 aa, synthetic construct; identical to SEQ ID NO: 5130

SEQ ID NO: 12128 - protein, 15 aa, synthetic construct
EAAAKGGGGSEAAAK

SEQ ID NO: 12129 - protein, 15 aa, synthetic construct
EAAAKGGGGSEAAAK

SEQ ID NO: 12130 - protein, 11 aa, synthetic construct
EAAAKGGGPAP

SEQ ID NO: 12131 - protein, 25 aa, synthetic construct
EAAAKEAAAKEAAAKEAAAKEAAAK

SEQ ID NO: 12132 - protein, 46 aa, synthetic construct; identical to SEQ ID NO: 5217

SEQ ID NO: 12133 - protein, 11 aa, synthetic construct
GGSEAAAKGGG

SEQ ID NO: 12134 - protein, 30 aa, synthetic construct; identical to SEQ ID NO: 5112

SEQ ID NO: 12135 - protein, 9 aa, synthetic construct
GGGPAPGGS

SEQ ID NO: 12136 - protein, 13 aa, synthetic construct
PAPAPAPAPAPAP

SEQ ID NO: 12137 - protein, 9 aa, synthetic construct
GGSGSSGGG

SEQ ID NO: 12138 - protein, 9 aa, synthetic construct
GGSGSSGGG

SEQ ID NO: 12139 - protein, 11 aa, synthetic construct
GGGEAAAKGGS

SEQ ID NO: 12140 - protein, 5 aa, synthetic construct
EAAAK

SEQ ID NO: 12141 - protein, 9 aa, synthetic construct
GGSPAPGSS

SEQ ID NO: 12142 - protein, 11 aa, synthetic construct
GGGGSSEAAAK

SEQ ID NO: 12143 - protein, 11 aa, synthetic construct
PAPAPAPAPAP

SEQ ID NO: 12144 - protein, 20 aa, synthetic construct
EAAAKEAAAKEAAAKEAAAK

SEQ ID NO: 12145 - protein, 9 aa, synthetic construct
GGGGGSGSS

SEQ ID NO: 12146 - protein, 11 aa, synthetic construct
EAAAKGSSPAP

SEQ ID NO: 12147 - protein, 13 aa, synthetic construct
PAPAPAPAPAPAP

SEQ ID NO: 12148 - protein, 9 aa, synthetic construct
GSSGGGGGS

SEQ ID NO: 12149 - protein, 9 aa, synthetic construct
PAPGSSGGG

SEQ ID NO: 12150 - protein, 9 aa, synthetic construct
GGSGGGPAP

SEQ ID NO: 12151 - protein, 7 aa, synthetic construct
GGGGGGG

SEQ ID NO: 12152 - protein, 18 aa, synthetic construct
GSSGSSGSSGSSGSSGSS

SEQ ID NO: 12153 - protein, 9 aa, synthetic construct
GGGPAPGGS

SEQ ID NO: 12154 - protein, 11 aa, synthetic construct
EAAAKGGSGGG

SEQ ID NO: 12155 - protein, 11 aa, synthetic construct
EAAAKGGGGSS

SEQ ID NO: 12156 - protein, 18 aa, synthetic construct
GSSGSSGSSGSSGSSGSS

SEQ ID NO: 12157 - protein, 20 aa, synthetic construct
GGGGSGGGGSGGGGSGGGGS

SEQ ID NO: 12158 - protein, 11 aa, synthetic construct
PAPAPAPAPAP

SEQ ID NO: 12159 - protein, 11 aa, synthetic construct
GGGEAAAKGGS

SEQ ID NO: 12160 - protein, 46 aa, synthetic construct; identical to SEQ ID NO: 5217

SEQ ID NO: 12161 - protein, 12 aa, synthetic construct
GSAGSAAGSGEF

SEQ ID NO: 12162 - protein, 15 aa, synthetic construct
GSSGSSGSSGSSGSS

SEQ ID NO: 12163 - protein, 11 aa, synthetic construct
EAAAKGGSGSS

SEQ ID NO: 12164 - protein, 6 aa, synthetic construct
PAPGGG

SEQ ID NO: 12165 - protein, 9 aa, synthetic construct
GGGPAPGSS

SEQ ID NO: 12166 - protein, 11 aa, synthetic construct
PAPEAAAKGGS

SEQ ID NO: 12167 - protein, 11 aa, synthetic construct
PAPGGGEAAAK

SEQ ID NO: 12168 - protein, 11 aa, synthetic construct
GGGGSSEAAAK

SEQ ID NO: 12169 - protein, 5 aa, synthetic construct
EAAAK

SEQ ID NO: 12170 - protein, 30 aa, synthetic construct; identical to SEQ ID NO: 5112

SEQ ID NO: 12171 - protein, 11 aa, synthetic construct
GGSGGGEAAAK

SEQ ID NO: 12172 - protein, 46 aa, synthetic construct; identical to SEQ ID NO: 5217

SEQ ID NO: 12173 - protein, 9 aa, synthetic construct
GSSPAPGGS

SEQ ID NO: 12174 - protein, 9 aa, synthetic construct
GGSGGGPAP

SEQ ID NO: 12175 - protein, 5 aa, synthetic construct
EAAAK

SEQ ID NO: 12176 - skipped

SEQ ID NO: 12177 - protein, 9 aa, synthetic construct
GGSGGSGGS

SEQ ID NO: 12178 - protein, 20 aa, synthetic construct
EAAAKEAAAKEAAAKEAAAK

SEQ ID NO: 12179 - protein, 11 aa, synthetic construct
PAPEAAAKGGG

SEQ ID NO: 12180 - protein, 11 aa, synthetic construct
GGGGGSEAAAK

SEQ ID NO: 12181 - protein, 9 aa, synthetic construct
GGSGSSGGG

SEQ ID NO: 12182 - protein, 7 aa, synthetic construct
GGGGGGG

SEQ ID NO: 12183 - protein, 11 aa, synthetic construct
GSSEAAAKPAP

SEQ ID NO: 12184 - protein, 11 aa, synthetic construct
GGGGGSEAAAK

SEQ ID NO: 12185 - protein, 25 aa, synthetic construct
GGGGSGGGGSGGGGSGGGGSGGGGS

SEQ ID NO: 12186 - protein, 11 aa, synthetic construct
GGGEAAAKGGS

SEQ ID NO: 12187 - protein, 9 aa, synthetic construct
GGSPAPGGG

SEQ ID NO: 12188 - protein, 12 aa, synthetic construct
GSAGSAAGSGEF

SEQ ID NO: 12189 - protein, 5 aa, synthetic construct
EAAAK

SEQ ID NO: 12190 - protein, 11 aa, synthetic construct
EAAAKPAPGSS

SEQ ID NO: 12191 - protein, 30 aa, synthetic construct; identical to SEQ ID NO: 5130

SEQ ID NO: 12192 - protein, 11 aa, synthetic construct
GGSEAAAKPAP

SEQ ID NO: 12193 - protein, 13 aa, synthetic construct
PAPAPAPAPAPAP

SEQ ID NO: 12194 - protein, 9 aa, synthetic construct
GGSPAPGGG

SEQ ID NO: 12195 - protein, 11 aa, synthetic construct
GGSEAAAKGGG

SEQ ID NO: 12196 - protein, 12 aa, synthetic construct
GGSGGSGGSGGS

SEQ ID NO: 12197 - protein, 30 aa, synthetic construct; identical to SEQ ID NO: 5130

SEQ ID NO: 12198 - skipped

SEQ ID NO: 12199 - protein, 46 aa, synthetic construct; identical to SEQ ID NO: 5217

SEQ ID NO: 12200 - protein, 12 aa, synthetic construct
GGSGGSGGSGGS

SEQ ID NO: 12201 - protein, 8 aa, synthetic construct
GGGEAAAK

SEQ ID NO: 12202 - protein, 18 aa, synthetic construct
GSSGSSGSSGSSGSSGSS

SEQ ID NO: 12203 - protein, 9 aa, synthetic construct
GSSGGGPAP

SEQ ID NO: 12204 - protein, 11 aa, synthetic construct
GSSEAAAKPAP

SEQ ID NO: 12205 - protein, 10 aa, synthetic construct
EAAAKEAAAK

SEQ ID NO: 12206 - protein, 30 aa, synthetic construct; identical to SEQ ID NO: 5112

SEQ ID NO: 12207 - protein, 6 aa, synthetic construct
GGGGGG

SEQ ID NO: 12208 - protein, 9 aa, synthetic construct
GGSGSSGGG

SEQ ID NO: 12209 - protein, 11 aa, synthetic construct
GSSGGGEAAAK

SEQ ID NO: 12210 - protein, 11 aa, synthetic construct
PAPAPAPAPAP

SEQ ID NO: 12211 - protein, 30 aa, synthetic construct; identical to SEQ ID NO: 5130

SEQ ID NO: 12212 - protein, 11 aa, synthetic construct
EAAAKGGSGGG

SEQ ID NO: 12213 - protein, 9 aa, synthetic construct
GGGGSSPAP

SEQ ID NO: 12214 - protein, 11 aa, synthetic construct
GGGEAAAKPAP

SEQ ID NO: 12215 - protein, 9 aa, synthetic construct
GGSGGGPAP

SEQ ID NO: 12216 - protein, 9 aa, synthetic construct
PAPGSSGGS

SEQ ID NO: 12217 - protein, 9 aa, synthetic construct
GGSGGGPAP

SEQ ID NO: 12218 - protein, 11 aa, synthetic construct
EAAAKGGSPAP

SEQ ID NO: 12219 - protein, 11 aa, synthetic construct
EAAAKGGSGGG

SEQ ID NO: 12220 - protein, 9 aa, synthetic construct
PAPGSSGGG

SEQ ID NO: 12221 - protein, 11 aa, synthetic construct
GSSEAAAKGGS

SEQ ID NO: 12222 - protein, 11 aa, synthetic construct
PAPGSSEAAAK

SEQ ID NO: 12223 - protein, 11 aa, synthetic construct
EAAAKGSSPAP

SEQ ID NO: 12224 - protein, 25 aa, synthetic construct
EAAAKEAAAKEAAAKEAAAKEAAAK

SEQ ID NO: 12225 - protein, 11 aa, synthetic construct
PAPGSSEAAAK

SEQ ID NO: 12226 - protein, 11 aa, synthetic construct
EAAAKGSSGGG

SEQ ID NO: 12227 - protein, 11 aa, synthetic construct
EAAAKGGGGGS

SEQ ID NO: 12228 - protein, 15 aa, synthetic construct
EAAAKEAAAKEAAAK

SEQ ID NO: 12229 - protein, 13 aa, synthetic construct
PAPAPAPAPAPAP

SEQ ID NO: 12230 - protein, 15 aa, synthetic construct
GGGGSGGGGSGGGGS

SEQ ID NO: 12231 - protein, 11 aa, synthetic construct
PAPGGSEAAAK

SEQ ID NO: 12232 - protein, 11 aa, synthetic construct
PAPGSSEAAAK

SEQ ID NO: 12233 - protein, 11 aa, synthetic construct
PAPEAAAKGSS

SEQ ID NO: 12234 - protein, 9 aa, synthetic construct
GGSPAPGSS

SEQ ID NO: 12235 - protein, 9 aa, synthetic construct
PAPGGSGGG

SEQ ID NO: 12236 - protein, 11 aa, synthetic construct
EAAAKGGSGSS

SEQ ID NO: 12237 - protein, 6 aa, synthetic construct
GGSGGG

SEQ ID NO: 12238 - protein, 11 aa, synthetic construct
GGSEAAAKGSS

SEQ ID NO: 12239 - protein, 46 aa, synthetic construct; identical to SEQ ID NO: 5217

SEQ ID NO: 12240 - protein, 13 aa, synthetic construct
PAPAPAPAPAPAP

SEQ ID NO: 12241 - protein, 8 aa, synthetic construct
PAPEAAAK

SEQ ID NO: 12242 - protein, 11 aa, synthetic construct
GGSEAAAKGGG

SEQ ID NO: 12243 - protein, 6 aa, synthetic construct
GSSPAP

SEQ ID NO: 12244 - protein, 6 aa, synthetic construct
GGGGSS

SEQ ID NO: 12245 - protein, 11 aa, synthetic construct
GGGEAAAKPAP

SEQ ID NO: 12246 - protein, 11 aa, synthetic construct
EAAAKPAPGGS

SEQ ID NO: 12247 - protein, 11 aa, synthetic construct
EAAAKGGGPAP

SEQ ID NO: 12248 - protein, 11 aa, synthetic construct
PAPGGSEAAAK

SEQ ID NO: 12249 - protein, 9 aa, synthetic construct
PAPGGSGSS

SEQ ID NO: 12250 - protein, 9 aa, synthetic construct
PAPGGSGSS

SEQ ID NO: 12251 - protein, 9 aa, synthetic construct
GGSGGGPAP

SEQ ID NO: 12252 - protein, 20 aa, synthetic construct
EAAAKEAAAKEAAAKEAAAK

SEQ ID NO: 12253 - protein, 25 aa, synthetic construct
GGGGSGGGGSGGGGSGGGGSGGGGS

SEQ ID NO: 12254 - protein, 9 aa, synthetic construct
GGGGSSPAP

SEQ ID NO: 12255 - protein, 9 aa, synthetic construct
GSSGGGPAP

SEQ ID NO: 12256 - protein, 9 aa, synthetic construct
GGGGSSGGS

SEQ ID NO: 12257 - protein, 6 aa, synthetic construct
GGSGGG

SEQ ID NO: 12258 - protein, 9 aa, synthetic construct
GSSGGGGGS

SEQ ID NO: 12259 - protein, 33 aa, synthetic construct; identical to SEQ ID NO: 5006

SEQ ID NO: 12260 - protein, 9 aa, synthetic construct
GGGGGSGSS

SEQ ID NO: 12261 - protein, 11 aa, synthetic construct
GGGEAAAKGGS

SEQ ID NO: 12262 - protein, 6 aa, synthetic construct
GGSGGG

SEQ ID NO: 12263 - protein, 7 aa, synthetic construct
PAPAPAP

SEQ ID NO: 12264 - protein, 46 aa, synthetic construct; identical to SEQ ID NO: 5217

SEQ ID NO: 12265 - protein, 46 aa, synthetic construct; identical to SEQ ID NO: 5217

SEQ ID NO: 12266 - protein, 15 aa, synthetic construct
GSSGSSGSSGSSGSS

SEQ ID NO: 12267 - protein, 11 aa, synthetic construct
GSSGGGEAAAK

SEQ ID NO: 12268 - protein, 11 aa, synthetic construct
GSSGGSEAAAK

SEQ ID NO: 12269 - skipped

SEQ ID NO: 12270 - protein, 15 aa, synthetic construct
EAAAKGGGGSEAAAK

SEQ ID NO: 12271 - protein, 5 aa, synthetic construct
PAPAP

SEQ ID NO: 12272 - skipped

SEQ ID NO: 12273 - protein, 6 aa, synthetic construct
GSSGGG

SEQ ID NO: 12274 - protein, 9 aa, synthetic construct
GSSPAPGGS

SEQ ID NO: 12275 - protein, 9 aa, synthetic construct
PAPAPAPAP

SEQ ID NO: 12276 - protein, 11 aa, synthetic construct
EAAAKGSSGGS

SEQ ID NO: 12277 - protein, 11 aa, synthetic construct
PAPEAAAKGGG

SEQ ID NO: 12278 - protein, 6 aa, synthetic construct
PAPGGS

SEQ ID NO: 12279 - protein, 8 aa, synthetic construct
EAAAKGGG

SEQ ID NO: 12280 - protein, 11 aa, synthetic construct
GSSEAAAKPAP

SEQ ID NO: 12281 - protein, 6 aa, synthetic construct
PAPGGS

SEQ ID NO: 12282 - protein, 8 aa, synthetic construct
EAAAKGGS

SEQ ID NO: 12283 - protein, 30 aa, synthetic construct; identical to SEQ ID NO: 5130

SEQ ID NO: 12284 - protein, 11 aa, synthetic construct
PAPGGSEAAAK

SEQ ID NO: 12285 - skipped

SEQ ID NO: 12286 - protein, 12 aa, synthetic construct
GSSGSSGSSGSS

SEQ ID NO: 12287 - protein, 9 aa, synthetic construct
GSSGSSGSS

SEQ ID NO: 12288 - protein, 6 aa, synthetic construct
GSSGGG

SEQ ID NO: 12289 - protein, 5 aa, synthetic construct
EAAAK

SEQ ID NO: 12290 - protein, 11 aa, synthetic construct
GGSPAPEAAAK

SEQ ID NO: 12291 - protein, 6 aa, synthetic construct
GGSGSS

SEQ ID NO: 12292 - protein, 9 aa, synthetic construct
GSSPAPGGG

SEQ ID NO: 12293 - protein, 25 aa, synthetic construct
EAAAKEAAAKEAAAKEAAAKEAAAK

SEQ ID NO: 12294 - protein, 11 aa, synthetic construct
EAAAKGSSPAP

SEQ ID NO: 12295 - protein, 6 aa, synthetic construct
GGGGSS

SEQ ID NO: 12296 - protein, 9 aa, synthetic construct
GGSPAPGSS

SEQ ID NO: 12297 - protein, 25 aa, synthetic construct
EAAAKEAAAKEAAAKEAAAKEAAAK

SEQ ID NO: 12298 - protein, 11 aa, synthetic construct
PAPEAAAKGGG

SEQ ID NO: 12299 - protein, 11 aa, synthetic construct
EAAAKPAPGGS

SEQ ID NO: 12300 - protein, 5 aa, synthetic construct
PAPAP

SEQ ID NO: 12301 - protein, 20 aa, synthetic construct
EAAAKEAAAKEAAAKEAAAK

SEQ ID NO: 12302 - protein, 9 aa, synthetic construct
GSSPAPGGG

SEQ ID NO: 12303 - protein, 11 aa, synthetic construct
EAAAKGGGPAP

SEQ ID NO: 12304 - protein, 8 aa, synthetic construct
PAPEAAAK

SEQ ID NO: 12305 - protein, 11 aa, synthetic construct
PAPGGGEAAAK

SEQ ID NO: 12306 - protein, 11 aa, synthetic construct
EAAAKGSSGGS

SEQ ID NO: 12307 - protein, 15 aa, synthetic construct
EAAAKEAAAKEAAAK

SEQ ID NO: 12308 - protein, 8 aa, synthetic construct
GSSEAAAK

SEQ ID NO: 12309 - protein, 12 aa, synthetic construct
GSSGSSGSSGSS

SEQ ID NO: 12310 - protein, 20 aa, synthetic construct
GGGGSGGGGSGGGGSGGGGS

SEQ ID NO: 12311 - protein, 15 aa, synthetic construct
EAAAKGGGGSEAAAK

SEQ ID NO: 12312 - skipped

SEQ ID NO: 12313 - protein, 30 aa, synthetic construct; identical to SEQ ID NO: 5112

SEQ ID NO: 12314 - protein, 9 aa, synthetic construct
GGSGSSPAP

SEQ ID NO: 12315 - protein, 15 aa, synthetic construct
GGGGSGGGGSGGGGS

SEQ ID NO: 12316 - protein, 11 aa, synthetic construct
PAPAPAPAPAP

SEQ ID NO: 12317 - protein, 11 aa, synthetic construct
PAPAPAPAPAP

SEQ ID NO: 12318 - protein, 20 aa, synthetic construct
EAAAKEAAAKEAAAKEAAAK

SEQ ID NO: 12319 - protein, 25 aa, synthetic construct
GGGGSGGGGSGGGGSGGGGSGGGGS

SEQ ID NO: 12320 - protein, 9 aa, synthetic construct
GGSGGSGGS

SEQ ID NO: 12321 - protein, 11 aa, synthetic construct
EAAAKPAPGSS

SEQ ID NO: 12322 - skipped

SEQ ID NO: 12323 - protein, 11 aa, synthetic construct
PAPEAAAKGGS

SEQ ID NO: 12324 - protein, 9 aa, synthetic construct
GGGPAPGGS

SEQ ID NO: 12325 - protein, 11 aa, synthetic construct
EAAAKGGGGSS

SEQ ID NO: 12326 - protein, 15 aa, synthetic construct
GSSGSSGSSGSSGSS

SEQ ID NO: 12327 - protein, 16 aa, synthetic construct
SGSETPGTSESATPES

SEQ ID NO: 12328 - protein, 11 aa, synthetic construct
GGSEAAAKGGG

SEQ ID NO: 12329 - protein, 18 aa, synthetic construct
GSSGSSGSSGSSGSSGSS

SEQ ID NO: 12330 - protein, 13 aa, synthetic construct
PAPAPAPAPAPAP

SEQ ID NO: 12331 - protein, 6 aa, synthetic construct
GGSGGS

SEQ ID NO: 12332 - protein, 11 aa, synthetic construct
PAPGSSEAAAK

SEQ ID NO: 12333 - protein, 11 aa, synthetic construct
GGSPAPEAAAK

SEQ ID NO: 12334 - protein, 11 aa, synthetic construct
EAAAKGGGGGS

SEQ ID NO: 12335 - protein, 12 aa, synthetic construct
GGSGGSGGSGGS

SEQ ID NO: 12336 - protein, 11 aa, synthetic construct
GGGGSSEAAAK

SEQ ID NO: 12337 - protein, 11 aa, synthetic construct
GSSEAAAKGGG

SEQ ID NO: 12338 - protein, 6 aa, synthetic construct
PAPGGS

SEQ ID NO: 12339 - protein, 11 aa, synthetic construct
EAAAKGGSGGG

SEQ ID NO: 12340 - protein, 8 aa, synthetic construct
EAAAKGGG

SEQ ID NO: 12341 - protein, 6 aa, synthetic construct
PAPGGS

SEQ ID NO: 12342 - protein, 9 aa, synthetic construct
GSSPAPGGG

SEQ ID NO: 12343 - protein, 11 aa, synthetic construct
PAPEAAAKGGG

SEQ ID NO: 12344 - protein, 11 aa, synthetic construct
GSSEAAAKGGG

SEQ ID NO: 12345 - protein, 11 aa, synthetic construct
PAPGGSEAAAK

SEQ ID NO: 12346 - protein, 6 aa, synthetic construct
GGGGGS

SEQ ID NO: 12347 - protein, 11 aa, synthetic construct
GGSPAPEAAAK

SEQ ID NO: 12348 - protein, 6 aa, synthetic construct
GGGPAP

SEQ ID NO: 12349 - protein, 9 aa, synthetic construct
PAPGSSGGG

SEQ ID NO: 12350 - protein, 9 aa, synthetic construct
PAPGSSGGG

SEQ ID NO: 12351 - protein, 11 aa, synthetic construct
GGGEAAAKGSS

SEQ ID NO: 12352 - protein, 11 aa, synthetic construct
GSSEAAAKGGS

SEQ ID NO: 12353 - protein, 9 aa, synthetic construct
PAPGGSGSS

SEQ ID NO: 12354 - protein, 15 aa, synthetic construct
EAAAKGGGGSEAAAK

SEQ ID NO: 12355 - protein, 7 aa, synthetic construct
PAPAPAP

SEQ ID NO: 12356 - protein, 6 aa, synthetic construct
GGGGGG

SEQ ID NO: 12357 - protein, 11 aa, synthetic construct
GSSPAPEAAAK

SEQ ID NO: 12358 - protein, 9 aa, synthetic construct
GGSGGSGGS

SEQ ID NO: 12359 - protein, 15 aa, synthetic construct
GSSGSSGSSGSSGSS

SEQ ID NO: 12360 - protein, 9 aa, synthetic construct
GGGPAPGGS

SEQ ID NO: 12361 - protein, 11 aa, synthetic construct
GGGPAPEAAAK

SEQ ID NO: 12362 - protein, 6 aa, synthetic construct
GGSGGG

SEQ ID NO: 12363 - protein, 16 aa, synthetic construct
SGSETPGTSESATPES

SEQ ID NO: 12364 - protein, 11 aa, synthetic construct
EAAAKGSSPAP

SEQ ID NO: 12365 - protein, 8 aa, synthetic construct
GSSEAAAK

SEQ ID NO: 12366 - protein, 9 aa, synthetic construct
GSSGGSGGG

SEQ ID NO: 12367 - protein, 25 aa, synthetic construct
EAAAKEAAAKEAAAKEAAAKEAAAK

SEQ ID NO: 12368 - protein, 15 aa, synthetic construct
GGGGSEAAAKGGGGS

SEQ ID NO: 12369 - protein, 9 aa, synthetic construct
PAPGGGGSS

SEQ ID NO: 12370 - protein, 16 aa, synthetic construct
SGSETPGTSESATPES

SEQ ID NO: 12371 - protein, 11 aa, synthetic construct
GGSPAPEAAAK

SEQ ID NO: 12372 - protein, 11 aa, synthetic construct
GSSEAAAKGGG

SEQ ID NO: 12373 - protein, 8 aa, synthetic construct
GSSEAAAK

SEQ ID NO: 12374 - protein, 15 aa, synthetic construct
GGGGSEAAAKGGGGS

SEQ ID NO: 12375 - skipped

SEQ ID NO: 12376 - protein, 11 aa, synthetic construct
PAPGGSEAAAK

SEQ ID NO: 12377 - protein, 5 aa, synthetic construct
GGGGS

SEQ ID NO: 12378 - protein, 6 aa, synthetic construct
GGGPAP

SEQ ID NO: 12379 - protein, 30 aa, synthetic construct; identical to SEQ ID NO: 5130

SEQ ID NO: 12380 - protein, 11 aa, synthetic construct
EAAAKPAPGSS

SEQ ID NO: 12381 - protein, 11 aa, synthetic construct
EAAAKPAPGSS

SEQ ID NO: 12382 - protein, 6 aa, synthetic construct
GGGGGG

SEQ ID NO: 12383 - protein, 11 aa, synthetic construct
EAAAKPAPGGS

SEQ ID NO: 12384 - protein, 11 aa, synthetic construct
PAPGGGEAAAK

SEQ ID NO: 12385 - protein, 25 aa, synthetic construct
EAAAKEAAAKEAAAKEAAAKEAAAK

SEQ ID NO: 12386 - protein, 11 aa, synthetic construct
GSSEAAAKPAP

SEQ ID NO: 12387 - protein, 11 aa, synthetic construct
PAPGGSEAAAK

SEQ ID NO: 12388 - protein, 6 aa, synthetic construct
PAPGSS

SEQ ID NO: 12389 - protein, 8 aa, synthetic construct
EAAAKGGG

SEQ ID NO: 12390 - protein, 8 aa, synthetic construct
EAAAKPAP

SEQ ID NO: 12391 - protein, 11 aa, synthetic construct
PAPEAAAKGGS

SEQ ID NO: 12392 - protein, 9 aa, synthetic construct
GGSPAPGGG

SEQ ID NO: 12393 - protein, 9 aa, synthetic construct
PAPGGSGSS

SEQ ID NO: 12394 - protein, 30 aa, synthetic construct; identical to SEQ ID NO: 5130

SEQ ID NO: 12395 - protein, 9 aa, synthetic construct
GGSGGGPAP

SEQ ID NO: 12396 - protein, 46 aa, synthetic construct; identical to SEQ ID NO: 5217

SEQ ID NO: 12397 - protein, 11 aa, synthetic construct
PAPEAAAKGSS

SEQ ID NO: 12398 - protein, 8 aa, synthetic construct
EAAAKGSS

SEQ ID NO: 12399 - protein, 6 aa, synthetic construct
GGSGGS

SEQ ID NO: 12400 - protein, 25 aa, synthetic construct
EAAAKEAAAKEAAAKEAAAKEAAAK

SEQ ID NO: 12401 - protein, 15 aa, synthetic construct
GGGGSEAAAKGGGGS

SEQ ID NO: 12402 - protein, 11 aa, synthetic construct
GGSEAAAKGGG

SEQ ID NO: 12403 - protein, 15 aa, synthetic construct
GSSGSSGSSGSSGSS

SEQ ID NO: 12404 - protein, 30 aa, synthetic construct; identical to SEQ ID NO: 5112

SEQ ID NO: 12405 - protein, 8 aa, synthetic construct
EAAAKGGG

SEQ ID NO: 12406 - protein, 11 aa, synthetic construct
GGGGGSEAAAK

SEQ ID NO: 12407 - protein, 11 aa, synthetic construct
EAAAKPAPGGS

SEQ ID NO: 12408 - protein, 9 aa, synthetic construct
GGGGGSGSS

SEQ ID NO: 12409 - protein, 11 aa, synthetic construct
PAPGSSEAAAK

SEQ ID NO: 12410 - protein, 11 aa, synthetic construct
GSSEAAAKPAP

SEQ ID NO: 12411 - protein, 11 aa, synthetic construct
EAAAKGSSPAP

SEQ ID NO: 12412 - protein, 9 aa, synthetic construct
GGGPAPGGS

SEQ ID NO: 12413 - protein, 6 aa, synthetic construct
GGSPAP

SEQ ID NO: 12414 - protein, 11 aa, synthetic construct
GGSEAAAKGGG

SEQ ID NO: 12415 - protein, 8 aa, synthetic construct
GGGGGGGG

SEQ ID NO: 12416 - protein, 30 aa, synthetic construct; identical to SEQ ID NO: 5112

SEQ ID NO: 12417 - protein, 30 aa, synthetic construct; identical to SEQ ID NO: 5112

SEQ ID NO: 12418 - protein, 9 aa, synthetic construct
GSSPAPGGG

SEQ ID NO: 12419 - protein, 6 aa, synthetic construct
GGGGGG

SEQ ID NO: 12420 - protein, 6 aa, synthetic construct
GSSGGS

SEQ ID NO: 12421 - protein, 9 aa, synthetic construct
GGSPAPGSS

SEQ ID NO: 12422 - protein, 11 aa, synthetic construct
PAPEAAAKGGG

SEQ ID NO: 12423 - protein, 11 aa, synthetic construct
EAAAKGGGPAP

SEQ ID NO: 12424 - protein, 11 aa, synthetic construct
GGGEAAAKGGS

SEQ ID NO: 12425 - protein, 9 aa, synthetic construct
GGSGSSPAP

SEQ ID NO: 12426 - protein, 16 aa, synthetic construct
SGSETPGTSESATPES

SEQ ID NO: 12427 - protein, 11 aa, synthetic construct
PAPGGSEAAAK

SEQ ID NO: 12428 - protein, 6 aa, synthetic construct
GGSGGG

SEQ ID NO: 12429 - protein, 9 aa, synthetic construct
GGGGSSPAP

SEQ ID NO: 12430 - protein, 11 aa, synthetic construct
GGGEAAAKGSS

SEQ ID NO: 12431 - protein, 13 aa, synthetic construct
PAPAPAPAPAPAP

SEQ ID NO: 12432 - protein, 15 aa, synthetic construct
EAAAKGGGGSEAAAK

SEQ ID NO: 12433 - protein, 25 aa, synthetic construct
EAAAKEAAAKEAAAKEAAAKEAAAK

SEQ ID NO: 12434 - protein, 11 aa, synthetic construct
GGGGGSEAAAK

SEQ ID NO: 12435 - protein, 11 aa, synthetic construct
PAPGSSEAAAK

SEQ ID NO: 12436 - protein, 12 aa, synthetic construct
GSAGSAAGSGEF

SEQ ID NO: 12437 - protein, 15 aa, synthetic construct
EAAAKGGGGSEAAAK

SEQ ID NO: 12438 - protein, 9 aa, synthetic construct
GGSPAPGGG

SEQ ID NO: 12439 - protein, 11 aa, synthetic construct
GSSEAAAKGGG

SEQ ID NO: 12440 - protein, 11 aa, synthetic construct
GGGEAAAKPAP

SEQ ID NO: 12441 - protein, 6 aa, synthetic construct
GGGPAP

SEQ ID NO: 12442 - protein, 8 aa, synthetic construct
GGSEAAAK

SEQ ID NO: 12443 - protein, 33 aa, synthetic construct; identical to SEQ ID NO: 5006

SEQ ID NO: 12444 - protein, 11 aa, synthetic construct
EAAAKPAPGGS

SEQ ID NO: 12445 - protein, 46 aa, synthetic construct; identical to SEQ ID NO: 5217

SEQ ID NO: 12446 - protein, 8 aa, synthetic construct
GGGGGGGG

SEQ ID NO: 12447 - protein, 6 aa, synthetic construct
PAPGSS

SEQ ID NO: 12448 - protein, 5 aa, synthetic construct
EAAAK

SEQ ID NO: 12449 - protein, 12 aa, synthetic construct
GSAGSAAGSGEF

SEQ ID NO: 12450 - protein, 11 aa, synthetic construct
PAPGGGEAAAK

SEQ ID NO: 12451 - protein, 11 aa, synthetic construct
EAAAKGSSGGS

SEQ ID NO: 12452 - protein, 15 aa, synthetic construct
GGGGSEAAAKGGGGS

SEQ ID NO: 12453 - protein, 15 aa, synthetic construct
GGGGSGGGGSGGGGS

SEQ ID NO: 12454 - protein, 15 aa, synthetic construct
EAAAKGGGGSEAAAK

SEQ ID NO: 12455 - protein, 11 aa, synthetic construct
PAPGGGEAAAK

SEQ ID NO: 12456 - protein, 11 aa, synthetic construct
GGSEAAAKPAP

SEQ ID NO: 12457 - protein, 5 aa, synthetic construct
PAPAP

SEQ ID NO: 12458 - protein, 5 aa, synthetic construct
PAPAP

SEQ ID NO: 12459 - protein, 6 aa, synthetic construct
GGSPAP

SEQ ID NO: 12460 - protein, 11 aa, synthetic construct
EAAAKGSSGGS

SEQ ID NO: 12461 - protein, 9 aa, synthetic construct
PAPGSSGGS

SEQ ID NO: 12462 - protein, 15 aa, synthetic construct
EAAAKGGGGSEAAAK

SEQ ID NO: 12463 - protein, 7 aa, synthetic construct
PAPAPAP

SEQ ID NO: 12464 - protein, 18 aa, synthetic construct
GGSGGSGGSGGSGGSGGS

SEQ ID NO: 12465 - protein, 9 aa, synthetic construct
GGGGGSGSS

SEQ ID NO: 12466 - protein, 11 aa, synthetic construct
PAPGSSEAAAK

SEQ ID NO: 12467 - protein, 11 aa, synthetic construct
GGSEAAAKPAP

SEQ ID NO: 12468 - protein, 20 aa, synthetic construct
EAAAKEAAAKEAAAKEAAAK

SEQ ID NO: 12469 - protein, 46 aa, synthetic construct; identical to SEQ ID NO: 5217

SEQ ID NO: 12470 - protein, 11 aa, synthetic construct
GGSGGGEAAAK

SEQ ID NO: 12471 - protein, 8 aa, synthetic construct
GGGEAAAK

SEQ ID NO: 12472 - protein, 15 aa, synthetic construct
GGGGSGGGGSGGGGS

SEQ ID NO: 12473 - protein, 15 aa, synthetic construct
GGSGGSGGSGGSGGS

SEQ ID NO: 12474 - protein, 9 aa, synthetic construct
GSSGGGGGS

SEQ ID NO: 12475 - protein, 11 aa, synthetic construct
PAPGGSEAAAK

SEQ ID NO: 12476 - protein, 9 aa, synthetic construct
GSSGGSPAP

SEQ ID NO: 12477 - protein, 16 aa, synthetic construct
SGSETPGTSESATPES

SEQ ID NO: 12478 - protein, 10 aa, synthetic construct
GGGGSGGGGS

SEQ ID NO: 12479 - protein, 11 aa, synthetic construct
PAPAPAPAPAP

SEQ ID NO: 12480 - protein, 6 aa, synthetic construct
GSSGSS

SEQ ID NO: 12481 - protein, 11 aa, synthetic construct
GSSEAAAKPAP

SEQ ID NO: 12482 - protein, 9 aa, synthetic construct
GGSGSSGGG

SEQ ID NO: 12483 - protein, 10 aa, synthetic construct
EAAAKEAAAK

SEQ ID NO: 12484 - protein, 12 aa, synthetic construct
GSSGSSGSSGSS

SEQ ID NO: 12485 - protein, 9 aa, synthetic construct
GSSPAPGGG

SEQ ID NO: 12486 - protein, 15 aa, synthetic construct
EAAAKEAAAKEAAAK

SEQ ID NO: 12487 - protein, 46 aa, synthetic construct; identical to SEQ ID NO: 5217

SEQ ID NO: 12488 - protein, 30 aa, synthetic construct; identical to SEQ ID NO: 5112

SEQ ID NO: 12489 - protein, 12 aa, synthetic construct
GSAGSAAGSGEF

SEQ ID NO: 12490 - protein, 11 aa, synthetic construct
PAPGSSEAAAK

SEQ ID NO: 12491 - protein, 8 aa, synthetic construct
GGSEAAAK

SEQ ID NO: 12492 - protein, 15 aa, synthetic construct
GSSGSSGSSGSSGSS

SEQ ID NO: 12493 - protein, 11 aa, synthetic construct
GGSEAAAKPAP

SEQ ID NO: 12494 - protein, 9 aa, synthetic construct
GGSGGSGGS

SEQ ID NO: 12495 - protein, 11 aa, synthetic construct
EAAAKGGSGSS

SEQ ID NO: 12496 - protein, 25 aa, synthetic construct
GGGGSGGGGSGGGGSGGGGSGGGGS

SEQ ID NO: 12497 - protein, 20 aa, synthetic construct
EAAAKEAAAKEAAAKEAAAK

SEQ ID NO: 12498 - protein, 9 aa, synthetic construct
GGSGSSPAP

SEQ ID NO: 12499 - protein, 25 aa, synthetic construct
EAAAKEAAAKEAAAKEAAAKEAAAK

SEQ ID NO: 12500 - protein, 25 aa, synthetic construct
GGGGSGGGGSGGGGSGGGGSGGGGS

SEQ ID NO: 12501 - protein, 6 aa, synthetic construct
GGSGSS

SEQ ID NO: 12502 - protein, 8 aa, synthetic construct
PAPEAAAK

SEQ ID NO: 12503 - protein, 8 aa, synthetic construct
EAAAKPAP

SEQ ID NO: 12504 - protein, 6 aa, synthetic construct
GSSPAP

SEQ ID NO: 12505 - protein, 6 aa, synthetic construct
GGGPAP

SEQ ID NO: 12506 - protein, 11 aa, synthetic construct
EAAAKGGSGSS

SEQ ID NO: 12507 - protein, 15 aa, synthetic construct
EAAAKGGGGSEAAAK

SEQ ID NO: 12508 - protein, 6 aa, synthetic construct
GGSGGG

SEQ ID NO: 12509 - protein, 6 aa, synthetic construct
GSSPAP

SEQ ID NO: 12510 - protein, 11 aa, synthetic construct
GGSGSSEAAAK

SEQ ID NO: 12511 - protein, 9 aa, synthetic construct
PAPGSSGGS

SEQ ID NO: 12512 - protein, 6 aa, synthetic construct
GGGGGG

SEQ ID NO: 12513 - protein, 11 aa, synthetic construct
PAPGGSEAAAK

SEQ ID NO: 12514 - protein, 6 aa, synthetic construct
PAPGGS

SEQ ID NO: 12515 - protein, 12 aa, synthetic construct
GGSGGSGGSGGS

SEQ ID NO: 12516 - protein, 6 aa, synthetic construct
GSSPAP

SEQ ID NO: 12517 - protein, 9 aa, synthetic construct
PAPAPAPAP

SEQ ID NO: 12518 - protein, 6 aa, synthetic construct
GGGGGG

SEQ ID NO: 12519 - protein, 18 aa, synthetic construct
GSSGSSGSSGSSGSSGSS

SEQ ID NO: 12520 - protein, 11 aa, synthetic construct
GSSEAAAKGGS

SEQ ID NO: 12521 - protein, 8 aa, synthetic construct
GGSEAAAK

SEQ ID NO: 12522 - protein, 15 aa, synthetic construct
GGSGGSGGSGGSGGS

SEQ ID NO: 12523 - protein, 11 aa, synthetic construct
GSSPAPEAAAK

SEQ ID NO: 12524 - protein, 15 aa, synthetic construct
GSSGSSGSSGSSGSS

SEQ ID NO: 12525 - protein, 11 aa, synthetic construct
EAAAKPAPGGS

SEQ ID NO: 12526 - protein, 33 aa, synthetic construct; identical to SEQ ID NO: 5006

SEQ ID NO: 12527 - protein, 11 aa, synthetic construct
GGSPAPEAAAK

SEQ ID NO: 12528 - protein, 11 aa, synthetic construct
EAAAKGGSGGG

SEQ ID NO: 12529 - protein, 20 aa, synthetic construct
EAAAKEAAAKEAAAKEAAAK

SEQ ID NO: 12530 - protein, 6 aa, synthetic construct
GSSPAP

SEQ ID NO: 12531 - protein, 9 aa, synthetic construct
PAPAPAPAP

SEQ ID NO: 12532 - protein, 11 aa, synthetic construct
PAPGGSEAAAK

SEQ ID NO: 12533 - protein, 11 aa, synthetic construct
GGSGSSEAAAK

SEQ ID NO: 12534 - protein, 6 aa, synthetic construct
GSSGGG

SEQ ID NO: 12535 - protein, 11 aa, synthetic construct
GGGEAAAKGSS

SEQ ID NO: 12536 - protein, 9 aa, synthetic construct
PAPGGSGGG

SEQ ID NO: 12537 - protein, 46 aa, synthetic construct; identical to SEQ ID NO: 5217

SEQ ID NO: 12538 - protein, 9 aa, synthetic construct
PAPGGGGSS

SEQ ID NO: 12539 - protein, 8 aa, synthetic construct
EAAAKGGS

SEQ ID NO: 12540 - protein, 30 aa, synthetic construct; identical to SEQ ID NO: 5130

SEQ ID NO: 12541 - protein, 9 aa, synthetic construct
GGSGGSGGS

SEQ ID NO: 12542 - protein, 5 aa, synthetic construct
PAPAP

SEQ ID NO: 12543 - protein, 11 aa, synthetic construct
GSSGGGEAAAK

SEQ ID NO: 12544 - protein, 11 aa, synthetic construct
GGGGSSEAAAK

SEQ ID NO: 12545 - protein, 11 aa, synthetic construct
EAAAKGSSGGS

SEQ ID NO: 12546 - protein, 15 aa, synthetic construct
EAAAKGGGGSEAAAK

SEQ ID NO: 12547 - protein, 8 aa, synthetic construct
GGGGGGGG

SEQ ID NO: 12548 - protein, 9 aa, synthetic construct
GSSGSSGSS

SEQ ID NO: 12549 - protein, 11 aa, synthetic construct
GGGEAAAKPAP

SEQ ID NO: 12550 - protein, 9 aa, synthetic construct
GGGGGSGSS

SEQ ID NO: 12551 - protein, 7 aa, synthetic construct
GGGGGGG

SEQ ID NO: 12552 - skipped

SEQ ID NO: 12553 - protein, 6 aa, synthetic construct
GSSGGG

SEQ ID NO: 12554 - protein, 11 aa, synthetic construct
EAAAKGGSGSS

SEQ ID NO: 12555 - protein, 11 aa, synthetic construct
PAPGSSEAAAK

SEQ ID NO: 12556 - protein, 11 aa, synthetic construct
GSSEAAAKPAP

SEQ ID NO: 12557 - protein, 9 aa, synthetic construct
GGSPAPGSS

SEQ ID NO: 12558 - protein, 12 aa, synthetic construct
GSAGSAAGSGEF

SEQ ID NO: 12559 - protein, 9 aa, synthetic construct
GGSPAPGGG

SEQ ID NO: 12560 - protein, 20 aa, synthetic construct
GGGGSGGGGSGGGGSGGGGS

SEQ ID NO: 12561 - protein, 9 aa, synthetic construct
GSSGSSGSS

SEQ ID NO: 12562 - protein, 30 aa, synthetic construct; identical to SEQ ID NO: 5130

SEQ ID NO: 12563 - protein, 15 aa, synthetic construct
GGGGSEAAAKGGGGS

SEQ ID NO: 12564 - protein, 11 aa, synthetic construct
GGSEAAAKGSS

SEQ ID NO: 12565 - protein, 15 aa, synthetic construct
EAAAKGGGGSEAAAK

SEQ ID NO: 12566 - protein, 30 aa, synthetic construct; identical to SEQ ID NO: 5130

SEQ ID NO: 12567 - protein, 11 aa, synthetic construct
PAPGGGEAAAK

SEQ ID NO: 12568 - protein, 11 aa, synthetic construct
GSSGGGEAAAK

SEQ ID NO: 12569 - protein, 6 aa, synthetic construct
GSSGSS

SEQ ID NO: 12570 - protein, 13 aa, synthetic construct
PAPAPAPAPAPAP

SEQ ID NO: 12571 - protein, 9 aa, synthetic construct
GGSPAPGGG

SEQ ID NO: 12572 - protein, 15 aa, synthetic construct
GGSGGSGGSGGSGGS

SEQ ID NO: 12573 - protein, 10 aa, synthetic construct
EAAAKEAAAK

SEQ ID NO: 12574 - protein, 46 aa, synthetic construct; identical to SEQ ID NO: 5217

SEQ ID NO: 12575 - protein, 13 aa, synthetic construct
PAPAPAPAPAPAP

SEQ ID NO: 12576 - protein, 11 aa, synthetic construct
GGGEAAAKGGS

SEQ ID NO: 12577 - protein, 11 aa, synthetic construct
EAAAKGGGPAP

SEQ ID NO: 12578 - protein, 11 aa, synthetic construct
PAPEAAAKGSS

SEQ ID NO: 12579 - protein, 11 aa, synthetic construct
PAPEAAAKGSS

SEQ ID NO: 12580 - protein, 11 aa, synthetic construct
PAPGGSEAAAK

SEQ ID NO: 12581 - protein, 9 aa, synthetic construct
GSSPAPGGG

SEQ ID NO: 12582 - protein, 11 aa, synthetic construct
GGGEAAAKPAP

SEQ ID NO: 12583 - protein, 10 aa, synthetic construct
GGGGSGGGGS

SEQ ID NO: 12584 - protein, 11 aa, synthetic construct
GGGEAAAKGSS

SEQ ID NO: 12585 - protein, 9 aa, synthetic construct
PAPGGGGSS

SEQ ID NO: 12586 - protein, 8 aa, synthetic construct
GSSEAAAK

SEQ ID NO: 12587 - protein, 8 aa, synthetic construct
GGGGGGGG

SEQ ID NO: 12588 - protein, 9 aa, synthetic construct
PAPGSSGGS

SEQ ID NO: 12589 - protein, 20 aa, synthetic construct
GGGGSGGGGSGGGGSGGGGS

SEQ ID NO: 12590 - skipped

SEQ ID NO: 12591 - protein, 11 aa, synthetic construct
EAAAKGSSPAP

SEQ ID NO: 12592 - protein, 11 aa, synthetic construct
PAPEAAAKGGS

SEQ ID NO: 12593 - protein, 11 aa, synthetic construct
GSSGGGEAAAK

SEQ ID NO: 12594 - protein, 7 aa, synthetic construct
PAPAPAP

SEQ ID NO: 12595 - protein, 11 aa, synthetic construct
GGSEAAAKGGG

SEQ ID NO: 12596 - protein, 8 aa, synthetic construct
GSSEAAAK

SEQ ID NO: 12597 - protein, 4 aa, synthetic construct
GGGG

SEQ ID NO: 12598 - protein, 6 aa, synthetic construct
GGGGGS

SEQ ID NO: 12599 - protein, 11 aa, synthetic construct
GGGGSSEAAAK

SEQ ID NO: 12600 - protein, 30 aa, synthetic construct; identical to SEQ ID NO: 5130

SEQ ID NO: 12601 - protein, 11 aa, synthetic construct
GGSEAAAKGSS

SEQ ID NO: 12602 - protein, 9 aa, synthetic construct
PAPGSSGGS

SEQ ID NO: 12603 - protein, 6 aa, synthetic construct
GGSPAP

SEQ ID NO: 12604 - protein, 11 aa, synthetic construct
GGGGSSEAAAK

SEQ ID NO: 12605 - protein, 12 aa, synthetic construct
GGSGGSGGSGGS

SEQ ID NO: 12606 - protein, 9 aa, synthetic construct
PAPGSSGGS

SEQ ID NO: 12607 - protein, 9 aa, synthetic construct
GSSPAPGGG

SEQ ID NO: 12608 - protein, 7 aa, synthetic construct
GGGGGGG

SEQ ID NO: 12609 - protein, 11 aa, synthetic construct
EAAAKGGGGGS

SEQ ID NO: 12610 - protein, 11 aa, synthetic construct
EAAAKGGSGGG

SEQ ID NO: 12611 - protein, 11 aa, synthetic construct
GGGGSSEAAAK

SEQ ID NO: 12612 - protein, 15 aa, synthetic construct
GGGGSEAAAKGGGGS

SEQ ID NO: 12613 - protein, 6 aa, synthetic construct
GSSGSS

SEQ ID NO: 12614 - protein, 6 aa, synthetic construct
GGSGGG

SEQ ID NO: 12615 - protein, 11 aa, synthetic construct
PAPEAAAKGGG

SEQ ID NO: 12616 - protein, 46 aa, synthetic construct; identical to SEQ ID NO: 5217

SEQ ID NO: 12617 - protein, 9 aa, synthetic construct
GGGGGSGSS

SEQ ID NO: 12618 - protein, 15 aa, synthetic construct
GSSGSSGSSGSSGSS

SEQ ID NO: 12619 - protein, 15 aa, synthetic construct
GGGGSEAAAKGGGGS

SEQ ID NO: 12620 - protein, 9 aa, synthetic construct
GGGGGSPAP

SEQ ID NO: 12621 - protein, 8 aa, synthetic construct
GGGEAAAK

SEQ ID NO: 12622 - protein, 12 aa, synthetic construct
GGSGGSGGSGGS

SEQ ID NO: 12623 - skipped

SEQ ID NO: 12624 - protein, 11 aa, synthetic construct
GGSPAPEAAAK

SEQ ID NO: 12625 - protein, 10 aa, synthetic construct
EAAAKEAAAK

SEQ ID NO: 12626 - protein, 11 aa, synthetic construct
GGGEAAAKPAP

SEQ ID NO: 12627 - protein, 11 aa, synthetic construct
GGGEAAAKGGS

SEQ ID NO: 12628 - protein, 9 aa, synthetic construct
GGSGGSGGS

SEQ ID NO: 12629 - protein, 11 aa, synthetic construct
EAAAKGGGPAP

SEQ ID NO: 12630 - protein, 5 aa, synthetic construct
EAAAK

SEQ ID NO: 12631 - protein, 11 aa, synthetic construct
PAPEAAAKGGG

SEQ ID NO: 12632 - protein, 8 aa, synthetic construct
EAAAKGSS

SEQ ID NO: 12633 - protein, 11 aa, synthetic construct
GGSEAAAKGGG

SEQ ID NO: 12634 - protein, 20 aa, synthetic construct
GGGGSGGGGSGGGGSGGGGS

SEQ ID NO: 12635 - protein, 25 aa, synthetic construct
GGGGSGGGGSGGGGSGGGGSGGGGS

SEQ ID NO: 12636 - protein, 9 aa, synthetic construct
GGGGSSPAP

SEQ ID NO: 12637 - protein, 18 aa, synthetic construct
GGSGGSGGSGGSGGSGGS

SEQ ID NO: 12638 - protein, 11 aa, synthetic construct
GGGEAAAKPAP

SEQ ID NO: 12639 - protein, 10 aa, synthetic construct
EAAAKEAAAK

SEQ ID NO: 12640 - protein, 11 aa, synthetic construct
GGSGSSEAAAK

SEQ ID NO: 12641 - protein, 11 aa, synthetic construct
PAPEAAAKGSS

SEQ ID NO: 12642 - protein, 11 aa, synthetic construct
PAPAPAPAPAP

SEQ ID NO: 12643 - protein, 11 aa, synthetic construct
GSSGGGEAAAK

SEQ ID NO: 12644 - protein, 9 aa, synthetic construct
GSSPAPGGG

SEQ ID NO: 12645 - protein, 11 aa, synthetic construct
GGSPAPEAAAK

SEQ ID NO: 12646 - protein, 11 aa, synthetic construct
PAPGGSEAAAK

SEQ ID NO: 12647 - protein, 6 aa, synthetic construct
GGGGSS

SEQ ID NO: 12648 - protein, 9 aa, synthetic construct
GGSGSSGGG

SEQ ID NO: 12649 - protein, 11 aa, synthetic construct
GSSGGGEAAAK

SEQ ID NO: 12650 - protein, 8 aa, synthetic construct
EAAAKGGS

SEQ ID NO: 12651 - protein, 9 aa, synthetic construct
GGGPAPGGS

SEQ ID NO: 12652 - protein, 10 aa, synthetic construct
EAAAKEAAAK

SEQ ID NO: 12653 - protein, 9 aa, synthetic construct
GSSGSSGSS

SEQ ID NO: 12654 - protein, 11 aa, synthetic construct
GGGEAAAKPAP

SEQ ID NO: 12655 - protein, 16 aa, synthetic construct
SGSETPGTSESATPES

SEQ ID NO: 12656 - protein, 11 aa, synthetic construct
PAPAPAPAPAP

SEQ ID NO: 12657 - protein, 46 aa, synthetic construct; identical to SEQ ID NO: 5217

SEQ ID NO: 12658 - protein, 9 aa, synthetic construct
PAPGSSGGG

SEQ ID NO: 12659 - protein, 11 aa, synthetic construct
GSSGGGEAAAK

SEQ ID NO: 12660 - protein, 25 aa, synthetic construct
GGGGSGGGGSGGGGSGGGGSGGGGS

SEQ ID NO: 12661 - protein, 9 aa, synthetic construct
GGGGSSPAP

SEQ ID NO: 12662 - protein, 9 aa, synthetic construct
GGSGGGPAP

SEQ ID NO: 12663 - skipped

SEQ ID NO: 12664 - protein, 11 aa, synthetic construct
EAAAKGSSPAP

SEQ ID NO: 12665 - protein, 8 aa, synthetic construct
EAAAKGGG

SEQ ID NO: 12666 - protein, 12 aa, synthetic construct
GSSGSSGSSGSS

SEQ ID NO: 12667 - protein, 11 aa, synthetic construct
PAPEAAAKGSS

SEQ ID NO: 12668 - protein, 8 aa, synthetic construct
GSSEAAAK

SEQ ID NO: 12669 - protein, 11 aa, synthetic construct
EAAAKGGSGSS

SEQ ID NO: 12670 - protein, 8 aa, synthetic construct
GSSEAAAK

SEQ ID NO: 12671 - protein, 11 aa, synthetic construct
GGSGSSEAAAK

SEQ ID NO: 12672 - protein, 11 aa, synthetic construct
GGSEAAAKGGG

SEQ ID NO: 12673 - protein, 20 aa, synthetic construct
GGGGSGGGGSGGGGSGGGGS

SEQ ID NO: 12674 - protein, 13 aa, synthetic construct
PAPAPAPAPAPAP

SEQ ID NO: 12675 - protein, 11 aa, synthetic construct
EAAAKPAPGSS

SEQ ID NO: 12676 - protein, 11 aa, synthetic construct
PAPGSSEAAAK

SEQ ID NO: 12677 - protein, 9 aa, synthetic construct
GGGGSSPAP

SEQ ID NO: 12678 - protein, 11 aa, synthetic construct
EAAAKGGGGGS

SEQ ID NO: 12679 - protein, 11 aa, synthetic construct
GGGEAAAKGGS

SEQ ID NO: 12680 - protein, 9 aa, synthetic construct
GGSGSSGGG

SEQ ID NO: 12681 - protein, 9 aa, synthetic construct
GGGPAPGGS

SEQ ID NO: 12682 - protein, 9 aa, synthetic construct
PAPGGGGGS

SEQ ID NO: 12683 - protein, 9 aa, synthetic construct
GGGPAPGSS

SEQ ID NO: 12684 - protein, 7 aa, synthetic construct
GGGGGGG

SEQ ID NO: 12685 - protein, 9 aa, synthetic construct
GGSGGGGSS

SEQ ID NO: 12686 - protein, 6 aa, synthetic construct
GGGGGG

SEQ ID NO: 12687 - protein, 11 aa, synthetic construct
GGSEAAAKGSS

SEQ ID NO: 12688 - protein, 9 aa, synthetic construct
GGSPAPGGG

SEQ ID NO: 12689 - protein, 9 aa, synthetic construct
GGSPAPGSS

SEQ ID NO: 12690 - protein, 12 aa, synthetic construct
GGSGGSGGSGGS

SEQ ID NO: 12691 - protein, 25 aa, synthetic construct
EAAAKEAAAKEAAAKEAAAKEAAAK

SEQ ID NO: 12692 - protein, 9 aa, synthetic construct
PAPGSSGGS

SEQ ID NO: 12693 - protein, 11 aa, synthetic construct
EAAAKGGGGSS

SEQ ID NO: 12694 - protein, 15 aa, synthetic construct
GGSGGSGGSGGSGGS

SEQ ID NO: 12695 - protein, 9 aa, synthetic construct
PAPGGSGGG

SEQ ID NO: 12696 - protein, 9 aa, synthetic construct
PAPGSSGGG

SEQ ID NO: 12697 - protein, 6 aa, synthetic construct
GSSGSS

SEQ ID NO: 12698 - protein, 8 aa, synthetic construct
EAAAKGSS

SEQ ID NO: 12699 - protein, 6 aa, synthetic construct
GGGPAP

SEQ ID NO: 12700 - protein, 11 aa, synthetic construct
EAAAKGGGGGS

SEQ ID NO: 12701 - protein, 11 aa, synthetic construct
EAAAKGGSPAP

SEQ ID NO: 12702 - protein, 30 aa, synthetic construct; identical to SEQ ID NO: 5130

SEQ ID NO: 12703 - protein, 9 aa, synthetic construct
GSSPAPGGG

SEQ ID NO: 12704 - protein, 11 aa, synthetic construct
GGGEAAAKGSS

SEQ ID NO: 12705 - protein, 11 aa, synthetic construct
GGGGSSEAAAK

SEQ ID NO: 12706 - protein, 8 aa, synthetic construct
GGGGGGGG

SEQ ID NO: 12707 - protein, 11 aa, synthetic construct
PAPGSSEAAAK

SEQ ID NO: 12708 - protein, 8 aa, synthetic construct
EAAAKGSS

SEQ ID NO: 12709 - protein, 11 aa, synthetic construct
GSSEAAAKGGG

SEQ ID NO: 12710 - protein, 8 aa, synthetic construct
GGSEAAAK

SEQ ID NO: 12711 - protein, 11 aa, synthetic construct
GSSEAAAKGGG

SEQ ID NO: 12712 - protein, 9 aa, synthetic construct
PAPGGSGGG

SEQ ID NO: 12713 - protein, 9 aa, synthetic construct
GSSGGSGGG

SEQ ID NO: 12714 - protein, 11 aa, synthetic construct
EAAAKGSSGGG

SEQ ID NO: 12715 - protein, 8 aa, synthetic construct
GSSEAAAK

SEQ ID NO: 12716 - protein, 11 aa, synthetic construct
GSSGGGEAAAK

SEQ ID NO: 12717 - protein, 10 aa, synthetic construct
GGGGSGGGGS

SEQ ID NO: 12718 - protein, 15 aa, synthetic construct
EAAAKGGGGSEAAAK

SEQ ID NO: 12719 - protein, 8 aa, synthetic construct
EAAAKGGG

SEQ ID NO: 12720 - protein, 11 aa, synthetic construct
EAAAKGGSPAP

SEQ ID NO: 12721 - protein, 9 aa, synthetic construct
GGGPAPGGS

SEQ ID NO: 12722 - protein, 8 aa, synthetic construct
GSSEAAAK

SEQ ID NO: 12723 - protein, 11 aa, synthetic construct
GSSGGGEAAAK

SEQ ID NO: 12724 - protein, 16 aa, synthetic construct
SGSETPGTSESATPES

SEQ ID NO: 12725 - protein, 9 aa, synthetic construct
GGSGSSPAP

SEQ ID NO: 12726 - protein, 6 aa, synthetic construct
GGGGGG

SEQ ID NO: 12727 - protein, 9 aa, synthetic construct
GGSPAPGGG

SEQ ID NO: 12728 - protein, 6 aa, synthetic construct
GGSGSS

SEQ ID NO: 12729 - skipped

SEQ ID NO: 12730 - protein, 11 aa, synthetic construct
EAAAKPAPGSS

SEQ ID NO: 12731 - protein, 8 aa, synthetic construct
EAAAKGGG

SEQ ID NO: 12732 - protein, 11 aa, synthetic construct
GSSEAAAKPAP

SEQ ID NO: 12733 - protein, 6 aa, synthetic construct
GGGGSS

SEQ ID NO: 12734 - protein, 11 aa, synthetic construct
GGSGSSEAAAK

SEQ ID NO: 12735 - protein, 6 aa, synthetic construct
GGGGSS

SEQ ID NO: 12736 - protein, 5 aa, synthetic construct
PAPAP

SEQ ID NO: 12737 - protein, 11 aa, synthetic construct
PAPEAAAKGGG

SEQ ID NO: 12738 - protein, 8 aa, synthetic construct
EAAAKGGS

SEQ ID NO: 12739 - protein, 13 aa, synthetic construct
PAPAPAPAPAPAP

SEQ ID NO: 12740 - protein, 11 aa, synthetic construct
GGGGGSEAAAK

SEQ ID NO: 12741 - protein, 6 aa, synthetic construct
PAPGGS

SEQ ID NO: 12742 - protein, 6 aa, synthetic construct
GGGGSS

SEQ ID NO: 12743 - protein, 5 aa, synthetic construct
GGGGS

SEQ ID NO: 12744 - protein, 11 aa, synthetic construct
GSSPAPEAAAK

SEQ ID NO: 12745 - protein, 9 aa, synthetic construct
GGGGSSGGS

SEQ ID NO: 12746 - protein, 11 aa, synthetic construct
PAPEAAAKGSS

SEQ ID NO: 12747 - protein, 11 aa, synthetic construct
GGSGSSEAAAK

SEQ ID NO: 12748 - protein, 8 aa, synthetic construct
EAAAKGGG

SEQ ID NO: 12749 - protein, 11 aa, synthetic construct
PAPGSSEAAAK

SEQ ID NO: 12750 - protein, 11 aa, synthetic construct
EAAAKGSSGGG

SEQ ID NO: 12751 - protein, 8 aa, synthetic construct
PAPEAAAK

SEQ ID NO: 12752 - protein, 11 aa, synthetic construct
GGSPAPEAAAK

SEQ ID NO: 12753 - protein, 18 aa, synthetic construct
GGSGGSGGSGGSGGSGGS

SEQ ID NO: 12754 - protein, 11 aa, synthetic construct
GSSEAAAKPAP

SEQ ID NO: 12755 - protein, 46 aa, synthetic construct; identical to SEQ ID NO: 5217

SEQ ID NO: 12756 - protein, 11 aa, synthetic construct
GSSGGGEAAAK

SEQ ID NO: 12757 - protein, 9 aa, synthetic construct
PAPGGSGGG

SEQ ID NO: 12758 - protein, 11 aa, synthetic construct
PAPGGSEAAAK

SEQ ID NO: 12759 - protein, 5 aa, synthetic construct
GGGGS

SEQ ID NO: 12760 - protein, 15 aa, synthetic construct
GGGGSGGGGSGGGGS

SEQ ID NO: 12761 - protein, 11 aa, synthetic construct
PAPAPAPAPAP

SEQ ID NO: 12762 - protein, 25 aa, synthetic construct
EAAAKEAAAKEAAAKEAAAKEAAAK

SEQ ID NO: 12763 - protein, 11 aa, synthetic construct
GSSGGSEAAAK

SEQ ID NO: 12764 - protein, 12 aa, synthetic construct
GGSGGSGGSGGS

SEQ ID NO: 12765 - protein, 11 aa, synthetic construct
EAAAKGSSGGG

SEQ ID NO: 12766 - protein, 8 aa, synthetic construct
EAAAKGGG

SEQ ID NO: 12767 - protein, 16 aa, synthetic construct
SGSETPGTSESATPES

SEQ ID NO: 12768 - protein, 9 aa, synthetic construct
PAPGSSGGS

SEQ ID NO: 12769 - protein, 11 aa, synthetic construct
PAPEAAAKGSS

SEQ ID NO: 12770 - protein, 8 aa, synthetic construct
PAPEAAAK

SEQ ID NO: 12771 - protein, 11 aa, synthetic construct
GSSEAAAKGGG

SEQ ID NO: 12772 - protein, 6 aa, synthetic construct
GSSPAP

SEQ ID NO: 12773 - protein, 20 aa, synthetic construct
EAAAKEAAAKEAAAKEAAAK

SEQ ID NO: 12774 - protein, 9 aa, synthetic construct
PAPGGSGSS

SEQ ID NO: 12775 - protein, 15 aa, synthetic construct
GGGGSGGGGSGGGGS

SEQ ID NO: 12776 - protein, 11 aa, synthetic construct
GSSGGSEAAAK

SEQ ID NO: 12777 - protein, 8 aa, synthetic construct
EAAAKGGS

SEQ ID NO: 12778 - protein, 8 aa, synthetic construct
EAAAKGGS

SEQ ID NO: 12779 - protein, 6 aa, synthetic construct
GGSPAP

SEQ ID NO: 12780 - protein, 6 aa, synthetic construct
GGSGSS

SEQ ID NO: 12781 - protein, 16 aa, synthetic construct
SGSETPGTSESATPES

SEQ ID NO: 12782 - protein, 7 aa, synthetic construct
GGGGGGG

SEQ ID NO: 12783 - protein, 9 aa, synthetic construct
GGSPAPGSS

SEQ ID NO: 12784 - protein, 9 aa, synthetic construct
GGGGSSGGS

SEQ ID NO: 12785 - protein, 6 aa, synthetic construct
PAPGGS

SEQ ID NO: 12786 - protein, 9 aa, synthetic construct
PAPGSSGGS

SEQ ID NO: 12787 - protein, 25 aa, synthetic construct
EAAAKEAAAKEAAAKEAAAKEAAAK

SEQ ID NO: 12788 - protein, 33 aa, synthetic construct; identical to SEQ ID NO: 5006

SEQ ID NO: 12789 - protein, 15 aa, synthetic construct
GGSGGSGGSGGSGGS

SEQ ID NO: 12790 - protein, 8 aa, synthetic construct
GSSEAAAK

SEQ ID NO: 12791 - protein, 20 aa, synthetic construct
EAAAKEAAAKEAAAKEAAAK

SEQ ID NO: 12792 - protein, 15 aa, synthetic construct
GGSGGSGGSGGSGGS

SEQ ID NO: 12793 - protein, 13 aa, synthetic construct
PAPAPAPAPAPAP

SEQ ID NO: 12794 - protein, 11 aa, synthetic construct
GGSPAPEAAAK

SEQ ID NO: 12795 - protein, 5 aa, synthetic construct
EAAAK

SEQ ID NO: 12796 - protein, 11 aa, synthetic construct
EAAAKGSSGGS

SEQ ID NO: 12797 - protein, 9 aa, synthetic construct
GGSGGGGSS

SEQ ID NO: 12798 - protein, 11 aa, synthetic construct
GGGEAAAKPAP

SEQ ID NO: 12799 - protein, 11 aa, synthetic construct
EAAAKGGSGGG

SEQ ID NO: 12800 - protein, 11 aa, synthetic construct
GGGGGSEAAAK

SEQ ID NO: 12801 - protein, 6 aa, synthetic construct
GGGGGG

SEQ ID NO: 12802 - protein, 6 aa, synthetic construct
GGGGGG

SEQ ID NO: 12803 - protein, 7 aa, synthetic construct
GGGGGGG

SEQ ID NO: 12804 - protein, 46 aa, synthetic construct; identical to SEQ ID NO: 5217

SEQ ID NO: 12805 - protein, 9 aa, synthetic construct
PAPGSSGGS

SEQ ID NO: 12806 - protein, 6 aa, synthetic construct
GGGGGS

SEQ ID NO: 12807 - protein, 8 aa, synthetic construct
EAAAKPAP

SEQ ID NO: 12808 - skipped

SEQ ID NO: 12809 - protein, 46 aa, synthetic construct; identical to SEQ ID NO: 5217

SEQ ID NO: 12810 - protein, 11 aa, synthetic construct
EAAAKGSSPAP

SEQ ID NO: 12811 - protein, 16 aa, synthetic construct
SGSETPGTSESATPES

SEQ ID NO: 12812 - protein, 11 aa, synthetic construct
GGSPAPEAAAK

SEQ ID NO: 12813 - protein, 12 aa, synthetic construct
GSSGSSGSSGSS

SEQ ID NO: 12814 - protein, 46 aa, synthetic construct; identical to SEQ ID NO: 5217

SEQ ID NO: 12815 - protein, 6 aa, synthetic construct
GGSPAP

SEQ ID NO: 12816 - protein, 11 aa, synthetic construct
GGGGGSEAAAK

SEQ ID NO: 12817 - protein, 5 aa, synthetic construct
GGGGG

SEQ ID NO: 12818 - protein, 8 aa, synthetic construct
GSSEAAAK

SEQ ID NO: 12819 - skipped

SEQ ID NO: 12820 - protein, 11 aa, synthetic construct
EAAAKGGSPAP

SEQ ID NO: 12821 - protein, 9 aa, synthetic construct
PAPAPAPAP

SEQ ID NO: 12822 - protein, 11 aa, synthetic construct
PAPGGGEAAAK

SEQ ID NO: 12823 - protein, 11 aa, synthetic construct
GGGGSSEAAAK

SEQ ID NO: 12824 - protein, 5 aa, synthetic construct
GGGGG

SEQ ID NO: 12825 - protein, 18 aa, synthetic construct
GGSGGSGGSGGSGGSGGS

SEQ ID NO: 12826 - protein, 5 aa, synthetic construct
GGGGG

SEQ ID NO: 12827 - protein, 11 aa, synthetic construct
PAPEAAAKGGG

SEQ ID NO: 12828 - protein, 9 aa, synthetic construct
GSSGGGPAP

SEQ ID NO: 12829 - protein, 18 aa, synthetic construct
GSSGSSGSSGSSGSSGSS

SEQ ID NO: 12830 - protein, 11 aa, synthetic construct
EAAAKGGSPAP

SEQ ID NO: 12831 - protein, 11 aa, synthetic construct
GSSGGSEAAAK

SEQ ID NO: 12832 - skipped

SEQ ID NO: 12833 - protein, 8 aa, synthetic construct
EAAAKGGS

SEQ ID NO: 12834 - protein, 9 aa, synthetic construct
GGGGGSPAP

SEQ ID NO: 12835 - protein, 8 aa, synthetic construct
EAAAKGSS

SEQ ID NO: 12836 - protein, 11 aa, synthetic construct
EAAAKGGGGSS

SEQ ID NO: 12837 - protein, 9 aa, synthetic construct
PAPGSSGGG

SEQ ID NO: 12838 - protein, 11 aa, synthetic construct
GGGGSSEAAAK

SEQ ID NO: 12839 - protein, 7 aa, synthetic construct
PAPAPAP

SEQ ID NO: 12840 - protein, 11 aa, synthetic construct
GSSGGSEAAAK

SEQ ID NO: 12841 - protein, 11 aa, synthetic construct
PAPEAAAKGSS

SEQ ID NO: 12842 - protein, 15 aa, synthetic construct
GGSGGSGGSGGSGGS

SEQ ID NO: 12843 - protein, 9 aa, synthetic construct
GGSGSSPAP

SEQ ID NO: 12844 - protein, 9 aa, synthetic construct
GGGGSSPAP

SEQ ID NO: 12845 - protein, 5 aa, synthetic construct
GGGGS

SEQ ID NO: 12846 - protein, 20 aa, synthetic construct
EAAAKEAAAKEAAAKEAAAK

SEQ ID NO: 12847 - protein, 10 aa, synthetic construct
EAAAKEAAAK

SEQ ID NO: 12848 - protein, 11 aa, synthetic construct
PAPGGGEAAAK

SEQ ID NO: 12849 - protein, 11 aa, synthetic construct
GSSGGSEAAAK

SEQ ID NO: 12850 - protein, 30 aa, synthetic construct; identical to SEQ ID NO: 5130

SEQ ID NO: 12851 - protein, 11 aa, synthetic construct
GSSEAAAKPAP

SEQ ID NO: 12852 - protein, 11 aa, synthetic construct
EAAAKPAPGSS

SEQ ID NO: 12853 - protein, 9 aa, synthetic construct
GSSGGSPAP

SEQ ID NO: 12854 - protein, 11 aa, synthetic construct
GSSEAAAKGGG

SEQ ID NO: 12855 - protein, 11 aa, synthetic construct
GGGEAAAKGGS

SEQ ID NO: 12856 - protein, 11 aa, synthetic construct
GSSEAAAKGGG

SEQ ID NO: 12857 - protein, 7 aa, synthetic construct
PAPAPAP

SEQ ID NO: 12858 - protein, 11 aa, synthetic construct
EAAAKGGSPAP

SEQ ID NO: 12859 - protein, 11 aa, synthetic construct
PAPGGSEAAAK

SEQ ID NO: 12860 - protein, 5 aa, synthetic construct
GGGGS

SEQ ID NO: 12861 - protein, 11 aa, synthetic construct
EAAAKGSSGGG

SEQ ID NO: 12862 - protein, 11 aa, synthetic construct
EAAAKGGGPAP

SEQ ID NO: 12863 - protein, 8 aa, synthetic construct
EAAAKGSS

SEQ ID NO: 12864 - protein, 9 aa, synthetic construct
GGSPAPGGG

SEQ ID NO: 12865 - protein, 15 aa, synthetic construct
GGGGSEAAAKGGGGS

SEQ ID NO: 12866 - protein, 11 aa, synthetic construct
GGGEAAAKGGS

SEQ ID NO: 12867 - protein, 11 aa, synthetic construct
EAAAKGGGGSS

SEQ ID NO: 12868 - protein, 11 aa, synthetic construct
EAAAKGGGPAP

SEQ ID NO: 12869 - protein, 6 aa, synthetic construct
GSSPAP

SEQ ID NO: 12870 - protein, 8 aa, synthetic construct
EAAAKGGS

SEQ ID NO: 12871 - protein, 6 aa, synthetic construct
GGGGSS

SEQ ID NO: 12872 - protein, 11 aa, synthetic construct
EAAAKGSSPAP

SEQ ID NO: 12873 - protein, 6 aa, synthetic construct
GGGPAP

SEQ ID NO: 12874 - protein, 11 aa, synthetic construct
EAAAKGSSGGS

SEQ ID NO: 12875 - protein, 6 aa, synthetic construct
PAPGGG

SEQ ID NO: 12876 - protein, 11 aa, synthetic construct
GSSPAPEAAAK

SEQ ID NO: 12877 - protein, 6 aa, synthetic construct
GGGPAP

SEQ ID NO: 12878 - protein, 9 aa, synthetic construct
GSSGGGGGS

SEQ ID NO: 12879 - protein, 16 aa, synthetic construct
SGSETPGTSESATPES

SEQ ID NO: 12880 - protein, 6 aa, synthetic construct
GGGPAP

SEQ ID NO: 12881 - protein, 11 aa, synthetic construct
EAAAKGGGGSS

SEQ ID NO: 12882 - protein, 9 aa, synthetic construct
GGGGSSPAP

SEQ ID NO: 12883 - protein, 15 aa, synthetic construct
GGGGSEAAAKGGGGS

SEQ ID NO: 12884 - protein, 6 aa, synthetic construct
GSSPAP

SEQ ID NO: 12885 - protein, 11 aa, synthetic construct
GGSGSSEAAAK

SEQ ID NO: 12886 - protein, 16 aa, synthetic construct
SGSETPGTSESATPES

SEQ ID NO: 12887 - protein, 6 aa, synthetic construct
PAPGGG

SEQ ID NO: 12888 - protein, 11 aa, synthetic construct
GGGEAAAKPAP

SEQ ID NO: 12889 - protein, 11 aa, synthetic construct
EAAAKGGSGSS

SEQ ID NO: 12890 - protein, 9 aa, synthetic construct
GGSPAPGGG

SEQ ID NO: 12891 - protein, 9 aa, synthetic construct
PAPGGSGSS

SEQ ID NO: 12892 - protein, 9 aa, synthetic construct
GSSGGSPAP

SEQ ID NO: 12893 - protein, 11 aa, synthetic construct
EAAAKGSSGGG

SEQ ID NO: 12894 - protein, 10 aa, synthetic construct
GGGGSGGGGS

SEQ ID NO: 12895 - protein, 9 aa, synthetic construct
GSSGGGGGS

SEQ ID NO: 12896 - protein, 9 aa, synthetic construct
GGGGSSGGS

SEQ ID NO: 12897 - protein, 8 aa, synthetic construct
EAAAKGGS

SEQ ID NO: 12898 - protein, 12 aa, synthetic construct
GSSGSSGSSGSS

SEQ ID NO: 12899 - skipped

SEQ ID NO: 12900 - protein, 11 aa, synthetic construct
GSSGGSEAAAK

SEQ ID NO: 12901 - protein, 33 aa, synthetic construct; identical to SEQ ID NO: 5006

SEQ ID NO: 12902 - protein, 5 aa, synthetic construct
GGGGG

SEQ ID NO: 12903 - protein, 11 aa, synthetic construct
PAPEAAAKGSS

SEQ ID NO: 12904 - protein, 6 aa, synthetic construct
GGGGGG

SEQ ID NO: 12905 - protein, 8 aa, synthetic construct
EAAAKGGG

SEQ ID NO: 12906 - protein, 6 aa, synthetic construct
GGGGSS

SEQ ID NO: 12907 - protein, 11 aa, synthetic construct
GSSGGGEAAAK

SEQ ID NO: 12908 - protein, 6 aa, synthetic construct
GGSGSS

SEQ ID NO: 12909 - protein, 8 aa, synthetic construct
EAAAKPAP

SEQ ID NO: 12910 - protein, 15 aa, synthetic construct
EAAAKEAAAKEAAAK

SEQ ID NO: 12911 - protein, 4 aa, synthetic construct
GGGG

SEQ ID NO: 12912 - protein, 9 aa, synthetic construct
GSSPAPGGS

SEQ ID NO: 12913 - protein, 9 aa, synthetic construct
GSSGGGGGS

SEQ ID NO: 12914 - protein, 9 aa, synthetic construct
GGGGSSGGS

SEQ ID NO: 12915 - skipped

SEQ ID NO: 12916 - protein, 5 aa, synthetic construct
GGGGG

SEQ ID NO: 12917 - protein, 18 aa, synthetic construct
GSSGSSGSSGSSGSSGSS

SEQ ID NO: 12918 - protein, 9 aa, synthetic construct
PAPGGGGSS

SEQ ID NO: 12919 - protein, 8 aa, synthetic construct
GGGGGGGG

SEQ ID NO: 12920 - protein, 16 aa, synthetic construct
SGSETPGTSESATPES

SEQ ID NO: 12921 - protein, 6 aa, synthetic construct
PAPGGG

SEQ ID NO: 12922 - protein, 9 aa, synthetic construct
GSSGSSGSS

SEQ ID NO: 12923 - protein, 6 aa, synthetic construct
GGSGSS

SEQ ID NO: 12924 - protein, 15 aa, synthetic construct
EAAAKGGGGSEAAAK

SEQ ID NO: 12925 - protein, 8 aa, synthetic construct
GGGGGGGG

SEQ ID NO: 12926 - protein, 6 aa, synthetic construct
GSSGSS

SEQ ID NO: 12927 - protein, 11 aa, synthetic construct
PAPEAAAKGGS

SEQ ID NO: 12928 - protein, 10 aa, synthetic construct
EAAAKEAAAK

SEQ ID NO: 12929 - protein, 15 aa, synthetic construct
GGGGSGGGGSGGGGS

SEQ ID NO: 12930 - protein, 11 aa, synthetic construct
EAAAKGSSPAP

SEQ ID NO: 12931 - protein, 11 aa, synthetic construct
GGGGSSEAAAK

SEQ ID NO: 12932 - protein, 11 aa, synthetic construct
GGGGSSEAAAK

SEQ ID NO: 12933 - protein, 9 aa, synthetic construct
PAPGGSGSS

SEQ ID NO: 12934 - protein, 11 aa, synthetic construct
GGSGGGEAAAK

SEQ ID NO: 12935 - protein, 11 aa, synthetic construct
PAPEAAAKGGS

SEQ ID NO: 12936 - protein, 9 aa, synthetic construct
GGGPAPGSS

SEQ ID NO: 12937 - protein, 9 aa, synthetic construct
PAPGGSGGG

SEQ ID NO: 12938 - protein, 8 aa, synthetic construct
GGGGGGGG

SEQ ID NO: 12939 - protein, 8 aa, synthetic construct
GSSEAAAK

SEQ ID NO: 12940 - protein, 15 aa, synthetic construct
GGGGSGGGGSGGGGS

SEQ ID NO: 12941 - protein, 8 aa, synthetic construct
EAAAKGGS

SEQ ID NO: 12942 - protein, 9 aa, synthetic construct
GGGGGSGSS

SEQ ID NO: 12943 - protein, 6 aa, synthetic construct
GGGPAP

SEQ ID NO: 12944 - protein, 11 aa, synthetic construct
EAAAKPAPGGG

SEQ ID NO: 12945 - protein, 9 aa, synthetic construct
GSSGGSPAP

SEQ ID NO: 12946 - protein, 33 aa, synthetic construct; identical to SEQ ID NO: 5006

SEQ ID NO: 12947 - protein, 9 aa, synthetic construct
PAPAPAPAP

SEQ ID NO: 12948 - protein, 6 aa, synthetic construct
GSSGGS

SEQ ID NO: 12949 - protein, 11 aa, synthetic construct
GSSEAAAKGGG

SEQ ID NO: 12950 - protein, 9 aa, synthetic construct
GGSGSSPAP

SEQ ID NO: 12951 - protein, 11 aa, synthetic construct
GSSEAAAKGGS

SEQ ID NO: 12952 - protein, 25 aa, synthetic construct
EAAAKEAAAKEAAAKEAAAKEAAAK

SEQ ID NO: 12953 - protein, 9 aa, synthetic construct
PAPGGGGSS

SEQ ID NO: 12954 - protein, 8 aa, synthetic construct
EAAAKGSS

SEQ ID NO: 12955 - protein, 46 aa, synthetic construct; identical to SEQ ID NO: 5217

SEQ ID NO: 12956 - protein, 18 aa, synthetic construct
GGSGGSGGSGGSGGSGGS

SEQ ID NO: 12957 - protein, 6 aa, synthetic construct
GGGGGG

SEQ ID NO: 12958 - protein, 8 aa, synthetic construct
PAPEAAAK

SEQ ID NO: 12959 - protein, 11 aa, synthetic construct
GGSGSSEAAAK

SEQ ID NO: 12960 - skipped

SEQ ID NO: 12961 - protein, 5 aa, synthetic construct
GGGGG

SEQ ID NO: 12962 - protein, 12 aa, synthetic construct
GGSGGSGGSGGS

SEQ ID NO: 12963 - protein, 18 aa, synthetic construct
GSSGSSGSSGSSGSSGSS

SEQ ID NO: 12964 - protein, 11 aa, synthetic construct
GSSEAAAKPAP

SEQ ID NO: 12965 - protein, 11 aa, synthetic construct
GGGEAAAKPAP

SEQ ID NO: 12966 - protein, 9 aa, synthetic construct
GSSGSSGSS

SEQ ID NO: 12967 - protein, 9 aa, synthetic construct
PAPAPAPAP

SEQ ID NO: 12968 - protein, 8 aa, synthetic construct
EAAAKGGG

SEQ ID NO: 12969 - protein, 13 aa, synthetic construct
PAPAPAPAPAPAP

SEQ ID NO: 12970 - protein, 11 aa, synthetic construct
EAAAKGGSGSS

SEQ ID NO: 12971 - protein, 6 aa, synthetic construct
GGGGGG

SEQ ID NO: 12972 - protein, 6 aa, synthetic construct
PAPGGG

SEQ ID NO: 12973 - protein, 9 aa, synthetic construct
GGGGGSGSS

SEQ ID NO: 12974 - protein, 20 aa, synthetic construct
GGGGSGGGGSGGGGSGGGGS

SEQ ID NO: 12975 - protein, 9 aa, synthetic construct
GGSGGSGGS

SEQ ID NO: 12976 - protein, 11 aa, synthetic construct
EAAAKPAPGGG

SEQ ID NO: 12977 - protein, 46 aa, synthetic construct; identical to SEQ ID NO: 5217

SEQ ID NO: 12978 - protein, 30 aa, synthetic construct; identical to SEQ ID NO: 5112

SEQ ID NO: 12979 - protein, 15 aa, synthetic construct
EAAAKGGGGSEAAAK

SEQ ID NO: 12980 - protein, 9 aa, synthetic construct
GGGPAPGSS

SEQ ID NO: 12981 - protein, 5 aa, synthetic construct
GGGGG

SEQ ID NO: 12982 - protein, 30 aa, synthetic construct; identical to SEQ ID NO: 5112

SEQ ID NO: 12983 - protein, 10 aa, synthetic construct
GGGGSGGGGS

SEQ ID NO: 12984 - protein, 11 aa, synthetic construct
EAAAKGGSPAP

SEQ ID NO: 12985 - protein, 11 aa, synthetic construct
EAAAKGSSPAP

SEQ ID NO: 12986 - protein, 9 aa, synthetic construct
PAPGGSGSS

SEQ ID NO: 12987-12988 - skipped (2 entries)

SEQ ID NO: 12989 - protein, 9 aa, synthetic construct
GGGPAPGSS

SEQ ID NO: 12990 - protein, 8 aa, synthetic construct
EAAAKPAP

SEQ ID NO: 12991 - protein, 11 aa, synthetic construct
GSSPAPEAAAK

SEQ ID NO: 12992 - protein, 9 aa, synthetic construct
GGSPAPGSS

SEQ ID NO: 12993 - protein, 11 aa, synthetic construct
GGGGGSEAAAK

SEQ ID NO: 12994 - protein, 11 aa, synthetic construct
PAPEAAAKGGG

SEQ ID NO: 12995 - protein, 6 aa, synthetic construct
PAPGGG

SEQ ID NO: 12996 - protein, 11 aa, synthetic construct
GGSPAPEAAAK

SEQ ID NO: 12997 - protein, 9 aa, synthetic construct
GGSGGGGSS

SEQ ID NO: 12998 - protein, 11 aa, synthetic construct
EAAAKGGGGSS

SEQ ID NO: 12999 - protein, 11 aa, synthetic construct
EAAAKGGSPAP

SEQ ID NO: 13000 - protein, 9 aa, synthetic construct
GGSGGGGSS

SEQ ID NO: 13001 - protein, 11 aa, synthetic construct
PAPGSSEAAAK

SEQ ID NO: 13002 - protein, 8 aa, synthetic construct
GSSEAAAK

SEQ ID NO: 13003 - protein, 12 aa, synthetic construct
GSAGSAAGSGEF

SEQ ID NO: 13004 - protein, 11 aa, synthetic construct
EAAAKGGSGSS

SEQ ID NO: 13005 - protein, 11 aa, synthetic construct
GGSEAAAKPAP

SEQ ID NO: 13006 - protein, 25 aa, synthetic construct
GGGGSGGGGSGGGGSGGGGSGGGGS

SEQ ID NO: 13007 - protein, 11 aa, synthetic construct
PAPGSSEAAAK

SEQ ID NO: 13008 - protein, 9 aa, synthetic construct
GGGGSSPAP

SEQ ID NO: 13009 - protein, 7 aa, synthetic construct
PAPAPAP

SEQ ID NO: 13010 - protein, 11 aa, synthetic construct
EAAAKPAPGGG

SEQ ID NO: 13011 - protein, 9 aa, synthetic construct
GGGPAPGSS

SEQ ID NO: 13012 - skipped

SEQ ID NO: 13013 - protein, 9 aa, synthetic construct
PAPGGSGGG

SEQ ID NO: 13014 - protein, 15 aa, synthetic construct
GGSGGSGGSGGSGGS

SEQ ID NO: 13015 - protein, 9 aa, synthetic construct
PAPAPAPAP

SEQ ID NO: 13016 - protein, 9 aa, synthetic construct
GSSPAPGGG

SEQ ID NO: 13017 - protein, 9 aa, synthetic construct
GSSPAPGGG

SEQ ID NO: 13018 - protein, 6 aa, synthetic construct
PAPGGG

SEQ ID NO: 13019 - protein, 11 aa, synthetic construct
GGGEAAAKGSS

SEQ ID NO: 13020 - protein, 8 aa, synthetic construct
EAAAKGSS

SEQ ID NO: 13021 - protein, 8 aa, synthetic construct
EAAAKGGS

SEQ ID NO: 13022 - protein, 25 aa, synthetic construct
EAAAKEAAAKEAAAKEAAAKEAAAK

SEQ ID NO: 13023 - protein, 11 aa, synthetic construct
PAPEAAAKGGG

SEQ ID NO: 13024 - protein, 11 aa, synthetic construct
EAAAKGSSGGG

SEQ ID NO: 13025 - protein, 46 aa, synthetic construct; identical to SEQ ID NO: 5217

SEQ ID NO: 13026 - protein, 30 aa, synthetic construct; identical to SEQ ID NO: 5130

SEQ ID NO: 13027 - protein, 9 aa, synthetic construct
GSSGGSGGG

SEQ ID NO: 13028 - protein, 12 aa, synthetic construct
GSSGSSGSSGSS

SEQ ID NO: 13029 - protein, 9 aa, synthetic construct
GGSPAPGGG

SEQ ID NO: 13030 - skipped

SEQ ID NO: 13031 - protein, 9 aa, synthetic construct
GGGPAPGSS

SEQ ID NO: 13032 - protein, 6 aa, synthetic construct
GGGGSS

SEQ ID NO: 13033 - protein, 9 aa, synthetic construct
GSSGGSGGG

SEQ ID NO: 13034 - protein, 15 aa, synthetic construct
EAAAKEAAAKEAAAK

SEQ ID NO: 13035 - protein, 33 aa, synthetic construct; identical to SEQ ID NO: 5006

SEQ ID NO: 13036 - protein, 9 aa, synthetic construct
PAPGGGGGS

SEQ ID NO: 13037 - protein, 11 aa, synthetic construct
PAPAPAPAPAP

SEQ ID NO: 13038 - protein, 5 aa, synthetic construct
EAAAK

SEQ ID NO: 13039 - skipped

SEQ ID NO: 13040 - protein, 11 aa, synthetic construct
GGSEAAAKGGG

SEQ ID NO: 13041 - protein, 9 aa, synthetic construct
GGGGGSGSS

SEQ ID NO: 13042 - protein, 11 aa, synthetic construct
EAAAKGSSPAP

SEQ ID NO: 13043 - protein, 9 aa, synthetic construct
GGSGGSGGS

SEQ ID NO: 13044 - protein, 11 aa, synthetic construct
EAAAKPAPGGG

SEQ ID NO: 13045 - protein, 11 aa, synthetic construct
GGGPAPEAAAK

SEQ ID NO: 13046 - protein, 11 aa, synthetic construct
GGSPAPEAAAK

SEQ ID NO: 13047 - protein, 15 aa, synthetic construct
GGSGGSGGSGGSGGS

SEQ ID NO: 13048 - protein, 11 aa, synthetic construct
EAAAKGGSGSS

SEQ ID NO: 13049 - protein, 11 aa, synthetic construct
GGGEAAAKGGS

SEQ ID NO: 13050 - protein, 9 aa, synthetic construct
PAPAPAPAP

SEQ ID NO: 13051 - protein, 20 aa, synthetic construct
EAAAKEAAAKEAAAKEAAAK

SEQ ID NO: 13052 - protein, 8 aa, synthetic construct
EAAAKPAP

SEQ ID NO: 13053 - protein, 10 aa, synthetic construct
EAAAKEAAAK

SEQ ID NO: 13054 - protein, 8 aa, synthetic construct
EAAAKGGG

SEQ ID NO: 13055 - protein, 8 aa, synthetic construct
EAAAKGSS

SEQ ID NO: 13056 - protein, 30 aa, synthetic construct; identical to SEQ ID NO: 5130

SEQ ID NO: 13057 - protein, 9 aa, synthetic construct
GGGPAPGSS

SEQ ID NO: 13058 - protein, 4 aa, synthetic construct
GGGG

SEQ ID NO: 13059 - protein, 11 aa, synthetic construct
EAAAKGGSGSS

SEQ ID NO: 13060 - protein, 15 aa, synthetic construct
GGGGSGGGGSGGGGS

SEQ ID NO: 13061 - protein, 5 aa, synthetic construct
EAAAK

SEQ ID NO: 13062 - protein, 6 aa, synthetic construct
GGGGSS

SEQ ID NO: 13063 - protein, 11 aa, synthetic construct
PAPEAAAKGGS

SEQ ID NO: 13064 - skipped

SEQ ID NO: 13065 - protein, 12 aa, synthetic construct
GSAGSAAGSGEF

SEQ ID NO: 13066 - protein, 30 aa, synthetic construct; identical to SEQ ID NO: 5130

SEQ ID NO: 13067 - protein, 10 aa, synthetic construct
GGGGSGGGGS

SEQ ID NO: 13068 - protein, 5 aa, synthetic construct
EAAAK

SEQ ID NO: 13069 - protein, 9 aa, synthetic construct
GGGPAPGGS

SEQ ID NO: 13070 - protein, 15 aa, synthetic construct
GGGGSGGGGSGGGGS

SEQ ID NO: 13071 - protein, 6 aa, synthetic construct
PAPGGG

SEQ ID NO: 13072 - protein, 11 aa, synthetic construct
GGGEAAAKPAP

SEQ ID NO: 13073 - protein, 11 aa, synthetic construct
EAAAKPAPGSS

SEQ ID NO: 13074 - protein, 6 aa, synthetic construct
PAPGSS

SEQ ID NO: 13075 - protein, 12 aa, synthetic construct
GSAGSAAGSGEF

SEQ ID NO: 13076 - protein, 9 aa, synthetic construct
PAPGGGGSS

SEQ ID NO: 13077 - protein, 11 aa, synthetic construct
GSSGGGEAAAK

SEQ ID NO: 13078 - skipped

SEQ ID NO: 13079 - protein, 12 aa, synthetic construct
GSSGSSGSSGSS

SEQ ID NO: 13080 - protein, 11 aa, synthetic construct
PAPEAAAKGGG

SEQ ID NO: 13081 - protein, 11 aa, synthetic construct
GGGPAPEAAAK

SEQ ID NO: 13082 - protein, 9 aa, synthetic construct
PAPGGGGGS

SEQ ID NO: 13083 - protein, 20 aa, synthetic construct
EAAAKEAAAKEAAAKEAAAK

SEQ ID NO: 13084 - protein, 9 aa, synthetic construct
GGGGGSPAP

SEQ ID NO: 13085 - protein, 15 aa, synthetic construct
GSSGSSGSSGSSGSS

SEQ ID NO: 13086 - protein, 11 aa, synthetic construct
GSSPAPEAAAK

SEQ ID NO: 13087 - protein, 18 aa, synthetic construct
GSSGSSGSSGSSGSSGSS

SEQ ID NO: 13088 - protein, 18 aa, synthetic construct
GSSGSSGSSGSSGSSGSS

SEQ ID NO: 13089 - protein, 11 aa, synthetic construct
GGSPAPEAAAK

SEQ ID NO: 13090 - protein, 6 aa, synthetic construct
GSSGGG

SEQ ID NO: 13091 - protein, 11 aa, synthetic construct
EAAAKGSSGGS

SEQ ID NO: 13092 - protein, 11 aa, synthetic construct
GGSGSSEAAAK

SEQ ID NO: 13093 - protein, 11 aa, synthetic construct
GGGPAPEAAAK

SEQ ID NO: 13094 - protein, 9 aa, synthetic construct
GGGPAPGGS

SEQ ID NO: 13095 - protein, 5 aa, synthetic construct
GGGGG

SEQ ID NO: 13096 - protein, 11 aa, synthetic construct
GGGEAAAKPAP

SEQ ID NO: 13097 - protein, 10 aa, synthetic construct
GGGGSGGGGS

SEQ ID NO: 13098 - protein, 11 aa, synthetic construct
GGGPAPEAAAK

SEQ ID NO: 13099 - protein, 11 aa, synthetic construct
GGSGSSEAAAK

SEQ ID NO: 13100 - protein, 11 aa, synthetic construct
EAAAKGGGPAP

SEQ ID NO: 13101 - protein, 15 aa, synthetic construct
GSSGSSGSSGSSGSS

SEQ ID NO: 13102 - protein, 5 aa, synthetic construct
PAPAP

SEQ ID NO: 13103 - protein, 9 aa, synthetic construct
GGSPAPGSS

SEQ ID NO: 13104 - protein, 9 aa, synthetic construct
GGSGGGPAP

SEQ ID NO: 13105 - protein, 6 aa, synthetic construct
GGSPAP

SEQ ID NO: 13106 - protein, 11 aa, synthetic construct
EAAAKGGSPAP

SEQ ID NO: 13107 - protein, 9 aa, synthetic construct
GSSPAPGGG

SEQ ID NO: 13108 - protein, 12 aa, synthetic construct
GSAGSAAGSGEF

SEQ ID NO: 13109 - protein, 6 aa, synthetic construct
GGSPAP

SEQ ID NO: 13110 - protein, 6 aa, synthetic construct
GSSGSS

SEQ ID NO: 13111 - protein, 9 aa, synthetic construct
GGGPAPGSS

SEQ ID NO: 13112 - protein, 46 aa, synthetic construct; identical to SEQ ID NO: 5217

SEQ ID NO: 13113 - protein, 9 aa, synthetic construct
PAPGSSGGG

SEQ ID NO: 13114 - protein, 11 aa, synthetic construct
GGSEAAAKPAP

SEQ ID NO: 13115 - protein, 6 aa, synthetic construct
GGGGGS

SEQ ID NO: 13116 - protein, 11 aa, synthetic construct
PAPEAAAKGGS

SEQ ID NO: 13117 - protein, 30 aa, synthetic construct; identical to SEQ ID NO: 5130

SEQ ID NO: 13118 - protein, 8 aa, synthetic construct
GGSEAAAK

SEQ ID NO: 13119 - protein, 11 aa, synthetic construct
GSSPAPEAAAK

SEQ ID NO: 13120 - protein, 6 aa, synthetic construct
PAPGGG

SEQ ID NO: 13121 - protein, 8 aa, synthetic construct
EAAAKPAP

SEQ ID NO: 13122 - protein, 15 aa, synthetic construct
GSSGSSGSSGSSGSS

SEQ ID NO: 13123 - protein, 6 aa, synthetic construct
PAPGGG

SEQ ID NO: 13124 - protein, 11 aa, synthetic construct
GGSGGGEAAAK

SEQ ID NO: 13125 - protein, 6 aa, synthetic construct
PAPGGS

SEQ ID NO: 13126 - protein, 12 aa, synthetic construct
GGSGGSGGSGGS

SEQ ID NO: 13127 - protein, 20 aa, synthetic construct
EAAAKEAAAKEAAAKEAAAK

SEQ ID NO: 13128 - protein, 11 aa, synthetic construct
GGSEAAAKGGG

SEQ ID NO: 13129 - protein, 6 aa, synthetic construct
GGGPAP

SEQ ID NO: 13130 - protein, 30 aa, synthetic construct; identical to SEQ ID NO: 5112

SEQ ID NO: 13131 - protein, 9 aa, synthetic construct
GGSPAPGSS

SEQ ID NO: 13132 - protein, 9 aa, synthetic construct
GGGPAPGSS

SEQ ID NO: 13133 - protein, 9 aa, synthetic construct
GGGGSSGGS

SEQ ID NO: 13134 - protein, 11 aa, synthetic construct
GGGEAAAKGSS

SEQ ID NO: 13135 - protein, 5 aa, synthetic construct
PAPAP

SEQ ID NO: 13136 - protein, 9 aa, synthetic construct
GGSPAPGGG

SEQ ID NO: 13137 - protein, 6 aa, synthetic construct
PAPGSS

SEQ ID NO: 13138 - protein, 9 aa, synthetic construct
GSSGGSPAP

SEQ ID NO: 13139 - protein, 15 aa, synthetic construct
EAAAKGGGGSEAAAK

SEQ ID NO: 13140 - protein, 11 aa, synthetic construct
GSSEAAAKGGS

SEQ ID NO: 13141 - protein, 9 aa, synthetic construct
PAPAPAPAP

SEQ ID NO: 13142 - protein, 11 aa, synthetic construct
GGSEAAAKPAP

SEQ ID NO: 13143 - protein, 6 aa, synthetic construct
PAPGGS

SEQ ID NO: 13144 - protein, 11 aa, synthetic construct
EAAAKGGGPAP

SEQ ID NO: 13145 - protein, 9 aa, synthetic construct
GGSGSSGGG

SEQ ID NO: 13146 - protein, 11 aa, synthetic construct
EAAAKGGSGSS

SEQ ID NO: 13147 - protein, 33 aa, synthetic construct; identical to SEQ ID NO: 5006

SEQ ID NO: 13148 - protein, 11 aa, synthetic construct
GSSEAAAKGGS

SEQ ID NO: 13149 - protein, 5 aa, synthetic construct
GGGGG

SEQ ID NO: 13150 - protein, 30 aa, synthetic construct; identical to SEQ ID NO: 5112

SEQ ID NO: 13151 - protein, 11 aa, synthetic construct
GGGEAAAKGSS

SEQ ID NO: 13152 - protein, 15 aa, synthetic construct
EAAAKGGGGSEAAAK

SEQ ID NO: 13153 - protein, 8 aa, synthetic construct
EAAAKGGG

SEQ ID NO: 13154 - protein, 6 aa, synthetic construct
GGSGGG

SEQ ID NO: 13155 - protein, 9 aa, synthetic construct
GGSGSSGGG

SEQ ID NO: 13156 - protein, 30 aa, synthetic construct; identical to SEQ ID NO: 5112

SEQ ID NO: 13157 - protein, 15 aa, synthetic construct
GGGGSEAAAKGGGGS

SEQ ID NO: 13158 - protein, 11 aa, synthetic construct
PAPAPAPAPAP

SEQ ID NO: 13159 - skipped

SEQ ID NO: 13160 - protein, 11 aa, synthetic construct
GGGGGSEAAAK

SEQ ID NO: 13161 - protein, 15 aa, synthetic construct
GSSGSSGSSGSSGSS

SEQ ID NO: 13162 - protein, 25 aa, synthetic construct
EAAAKEAAAKEAAAKEAAAKEAAAK

SEQ ID NO: 13163 - protein, 9 aa, synthetic construct
GGSGSSGGG

SEQ ID NO: 13164 - skipped

SEQ ID NO: 13165 - protein, 11 aa, synthetic construct
GSSPAPEAAAK

SEQ ID NO: 13166 - protein, 11 aa, synthetic construct
EAAAKGGGGSS

SEQ ID NO: 13167 - protein, 11 aa, synthetic construct
GGGEAAAKGGS

SEQ ID NO: 13168 - protein, 9 aa, synthetic construct
GGSGGGPAP

SEQ ID NO: 13169 - protein, 12 aa, synthetic construct
GSAGSAAGSGEF

SEQ ID NO: 13170 - protein, 8 aa, synthetic construct
GSSEAAAK

SEQ ID NO: 13171 - protein, 6 aa, synthetic construct
PAPGSS

SEQ ID NO: 13172 - protein, 15 aa, synthetic construct
EAAAKEAAAKEAAAK

SEQ ID NO: 13173 - protein, 12 aa, synthetic construct
GSAGSAAGSGEF

SEQ ID NO: 13174 - protein, 12 aa, synthetic construct
GSSGSSGSSGSS

SEQ ID NO: 13175 - protein, 46 aa, synthetic construct; identical to SEQ ID NO: 5217

SEQ ID NO: 13176 - protein, 11 aa, synthetic construct
GGGGSSEAAAK

SEQ ID NO: 13177 - protein, 11 aa, synthetic construct
GSSGGGEAAAK

SEQ ID NO: 13178 - protein, 8 aa, synthetic construct
EAAAKPAP

SEQ ID NO: 13179 - protein, 9 aa, synthetic construct
GGSPAPGGG

SEQ ID NO: 13180 - protein, 8 aa, synthetic construct
PAPEAAAK

SEQ ID NO: 13181 - protein, 9 aa, synthetic construct
GSSGSSGSS

SEQ ID NO: 13182 - protein, 11 aa, synthetic construct
GSSGGGEAAAK

SEQ ID NO: 13183 - protein, 6 aa, synthetic construct
GGSPAP

SEQ ID NO: 13184 - protein, 12 aa, synthetic construct
GSAGSAAGSGEF

SEQ ID NO: 13185 - protein, 11 aa, synthetic construct
PAPGGSEAAAK

SEQ ID NO: 13186 - protein, 11 aa, synthetic construct
GGSPAPEAAAK

SEQ ID NO: 13187 - protein, 9 aa, synthetic construct
GGGGGSPAP

SEQ ID NO: 13188 - protein, 11 aa, synthetic construct
EAAAKGSSPAP

SEQ ID NO: 13189 - protein, 11 aa, synthetic construct
EAAAKGGGPAP

SEQ ID NO: 13190 - protein, 6 aa, synthetic construct
PAPGSS

SEQ ID NO: 13191 - protein, 9 aa, synthetic construct
GGSGSSGGG

SEQ ID NO: 13192 - protein, 33 aa, synthetic construct; identical to SEQ ID NO: 5006

SEQ ID NO: 13193 - protein, 18 aa, synthetic construct
GGSGGSGGSGGSGGSGGS

SEQ ID NO: 13194 - protein, 9 aa, synthetic construct
GGSGGSGGS

SEQ ID NO: 13195 - protein, 5 aa, synthetic construct
GGGGG

SEQ ID NO: 13196 - protein, 6 aa, synthetic construct
GGGPAP

SEQ ID NO: 13197 - protein, 9 aa, synthetic construct
PAPGGSGGG

SEQ ID NO: 13198 - protein, 15 aa, synthetic construct
GGGGSEAAAKGGGGS

SEQ ID NO: 13199 - protein, 11 aa, synthetic construct
EAAAKGSSGGG

SEQ ID NO: 13200 - protein, 11 aa, synthetic construct
GSSGGSEAAAK

SEQ ID NO: 13201 - protein, 11 aa, synthetic construct
EAAAKGGSGSS

SEQ ID NO: 13202 - protein, 11 aa, synthetic construct
PAPAPAPAPAP

SEQ ID NO: 13203 - protein, 30 aa, synthetic construct; identical to SEQ ID NO: 5112

SEQ ID NO: 13204 - protein, 7 aa, synthetic construct
GGGGGGG

SEQ ID NO: 13205 - protein, 5 aa, synthetic construct
EAAAK

SEQ ID NO: 13206 - protein, 11 aa, synthetic construct
GGGEAAAKGGS

SEQ ID NO: 13207 - protein, 11 aa, synthetic construct
GGGEAAAKGGS

SEQ ID NO: 13208 - protein, 9 aa, synthetic construct
GGGGGSPAP

SEQ ID NO: 13209 - protein, 20 aa, synthetic construct
GGGGSGGGGSGGGGSGGGGS

SEQ ID NO: 13210 - protein, 7 aa, synthetic construct
GGGGGGG

SEQ ID NO: 13211 - protein, 13 aa, synthetic construct
PAPAPAPAPAPAP

SEQ ID NO: 13212 - protein, 9 aa, synthetic construct
GSSPAPGGG

SEQ ID NO: 13213 - protein, 9 aa, synthetic construct
GGGGGSPAP

SEQ ID NO: 13214 - protein, 15 aa, synthetic construct
GGGGSGGGGSGGGGS

SEQ ID NO: 13215 - protein, 15 aa, synthetic construct
GGGGSGGGGSGGGGS

SEQ ID NO: 13216 - protein, 11 aa, synthetic construct
GSSEAAAKGGS

SEQ ID NO: 13217 - protein, 15 aa, synthetic construct
GSSGSSGSSGSSGSS

SEQ ID NO: 13218 - protein, 11 aa, synthetic construct
EAAAKGGGGGS

SEQ ID NO: 13219 - protein, 9 aa, synthetic construct
GSSGGGGGS

SEQ ID NO: 13220 - protein, 11 aa, synthetic construct
GGGEAAAKPAP

SEQ ID NO: 13221 - protein, 9 aa, synthetic construct
GSSGGSPAP

SEQ ID NO: 13222 - protein, 9 aa, synthetic construct
GSSGGGPAP

SEQ ID NO: 13223 - protein, 9 aa, synthetic construct
GGGGGSGSS

SEQ ID NO: 13224 - protein, 46 aa, synthetic construct; identical to SEQ ID NO: 5217

SEQ ID NO: 13225 - protein, 8 aa, synthetic construct
PAPEAAAK

SEQ ID NO: 13226 - protein, 15 aa, synthetic construct
GGGGSGGGGSGGGGS

SEQ ID NO: 13227 - protein, 9 aa, synthetic construct
GGSGSSGGG

SEQ ID NO: 13228 - protein, 8 aa, synthetic construct
EAAAKGGS

SEQ ID NO: 13229 - protein, 11 aa, synthetic construct
EAAAKGSSPAP

SEQ ID NO: 13230 - protein, 11 aa, synthetic construct
EAAAKGGSGSS

SEQ ID NO: 13231 - protein, 6 aa, synthetic construct
GSSGSS

SEQ ID NO: 13232 - protein, 9 aa, synthetic construct
PAPAPAPAP

SEQ ID NO: 13233 - protein, 6 aa, synthetic construct
GGSGGG

SEQ ID NO: 13234-13235 - skipped (2 entries)

SEQ ID NO: 13236 - protein, 11 aa, synthetic construct
GGSGSSEAAAK

SEQ ID NO: 13237 - protein, 11 aa, synthetic construct
PAPEAAAKGSS

SEQ ID NO: 13238 - protein, 6 aa, synthetic construct
GGSGGS

SEQ ID NO: 13239 - protein, 7 aa, synthetic construct
GGGGGGG

SEQ ID NO: 13240 - protein, 11 aa, synthetic construct
GGSPAPEAAAK

SEQ ID NO: 13241 - protein, 30 aa, synthetic construct; identical to SEQ ID NO: 5130

SEQ ID NO: 13242 - protein, 6 aa, synthetic construct
GGSPAP

SEQ ID NO: 13243 - protein, 11 aa, synthetic construct
GGSEAAAKGGG

SEQ ID NO: 13244 - protein, 10 aa, synthetic construct
GGGGSGGGGS

SEQ ID NO: 13245 - protein, 8 aa, synthetic construct
GGGEAAAK

SEQ ID NO: 13246 - protein, 30 aa, synthetic construct; identical to SEQ ID NO: 5112

SEQ ID NO: 13247 - protein, 11 aa, synthetic construct
GGSEAAAKPAP

SEQ ID NO: 13248 - protein, 11 aa, synthetic construct
GSSGGGEAAAK

SEQ ID NO: 13249 - protein, 11 aa, synthetic construct
GGGGGSEAAAK

SEQ ID NO: 13250 - protein, 11 aa, synthetic construct
EAAAKGGSGGG

SEQ ID NO: 13251 - protein, 9 aa, synthetic construct
GGGGSSPAP

SEQ ID NO: 13252 - protein, 10 aa, synthetic construct
EAAAKEAAAK

SEQ ID NO: 13253 - protein, 46 aa, synthetic construct; identical to SEQ ID NO: 5217

SEQ ID NO: 13254 - protein, 15 aa, synthetic construct
GSSGSSGSSGSSGSS

SEQ ID NO: 13255 - protein, 6 aa, synthetic construct
GSSGGG

SEQ ID NO: 13256 - protein, 6 aa, synthetic construct
GSSGGS

SEQ ID NO: 13257 - protein, 10 aa, synthetic construct
GGGGSGGGGS

SEQ ID NO: 13258 - protein, 6 aa, synthetic construct
PAPGSS

SEQ ID NO: 13259 - protein, 11 aa, synthetic construct
GGGPAPEAAAK

SEQ ID NO: 13260 - protein, 8 aa, synthetic construct
EAAAKGGS

SEQ ID NO: 13261 - skipped

SEQ ID NO: 13262 - protein, 4 aa, synthetic construct
GGGG

SEQ ID NO: 13263 - protein, 11 aa, synthetic construct
GGGGGSEAAAK

SEQ ID NO: 13264 - protein, 15 aa, synthetic construct
GSSGSSGSSGSSGSS

SEQ ID NO: 13265 - protein, 9 aa, synthetic construct
PAPGGSGGG

SEQ ID NO: 13266 - protein, 6 aa, synthetic construct
GGGPAP

SEQ ID NO: 13267 - protein, 11 aa, synthetic construct
GGGPAPEAAAK

SEQ ID NO: 13268 - protein, 8 aa, synthetic construct
GGGEAAAK

SEQ ID NO: 13269 - skipped

SEQ ID NO: 13270 - protein, 11 aa, synthetic construct
EAAAKPAPGSS

SEQ ID NO: 13271 - protein, 11 aa, synthetic construct
GGSGSSEAAAK

SEQ ID NO: 13272 - protein, 8 aa, synthetic construct
EAAAKGSS

SEQ ID NO: 13273 - protein, 11 aa, synthetic construct
GGSGSSEAAAK

SEQ ID NO: 13274 - protein, 6 aa, synthetic construct
GGSGGG

SEQ ID NO: 13275 - protein, 6 aa, synthetic construct
GGGPAP

SEQ ID NO: 13276 - protein, 9 aa, synthetic construct
GGSPAPGGG

SEQ ID NO: 13277 - protein, 11 aa, synthetic construct
GGGGGSEAAAK

SEQ ID NO: 13278 - protein, 11 aa, synthetic construct
EAAAKGSSGGS

SEQ ID NO: 13279 - protein, 5 aa, synthetic construct
PAPAP

SEQ ID NO: 13280 - protein, 9 aa, synthetic construct
GSSPAPGGS

SEQ ID NO: 13281 - protein, 11 aa, synthetic construct
GSSEAAAKGGG

SEQ ID NO: 13282 - protein, 11 aa, synthetic construct
EAAAKGGGGGS

SEQ ID NO: 13283 - protein, 15 aa, synthetic construct
GSSGSSGSSGSSGSS

SEQ ID NO: 13284 - protein, 11 aa, synthetic construct
EAAAKGGGGSS

SEQ ID NO: 13285 - protein, 8 aa, synthetic construct
EAAAKGSS

SEQ ID NO: 13286 - protein, 30 aa, synthetic construct; identical to SEQ ID NO: 5130

SEQ ID NO: 13287 - protein, 8 aa, synthetic construct
EAAAKGGS

SEQ ID NO: 13288 - protein, 11 aa, synthetic construct
GSSGGSEAAAK

SEQ ID NO: 13289 - protein, 11 aa, synthetic construct
EAAAKPAPGGS

SEQ ID NO: 13290 - protein, 6 aa, synthetic construct
GGSGGS

SEQ ID NO: 13291 - protein, 11 aa, synthetic construct
EAAAKGSSGGG

SEQ ID NO: 13292 - protein, 12 aa, synthetic construct
GGSGGSGGSGGS

SEQ ID NO: 13293 - protein, 8 aa, synthetic construct
GGGGGGGG

SEQ ID NO: 13294 - protein, 11 aa, synthetic construct
GGSGSSEAAAK

SEQ ID NO: 13295 - protein, 8 aa, synthetic construct
EAAAKGGG

SEQ ID NO: 13296 - protein, 15 aa, synthetic construct
GGGGSGGGGSGGGGS

SEQ ID NO: 13297 - protein, 12 aa, synthetic construct
GGSGGSGGSGGS

SEQ ID NO: 13298 - protein, 11 aa, synthetic construct
PAPAPAPAPAP

SEQ ID NO: 13299 - protein, 20 aa, synthetic construct
EAAAKEAAAKEAAAKEAAAK

SEQ ID NO: 13300 - protein, 9 aa, synthetic construct
GGSGGSGGS

SEQ ID NO: 13301 - protein, 9 aa, synthetic construct
PAPGGGGSS

SEQ ID NO: 13302 - protein, 11 aa, synthetic construct
GSSEAAAKGGS

SEQ ID NO: 13303 - protein, 9 aa, synthetic construct
GSSGGGPAP

SEQ ID NO: 13304 - protein, 6 aa, synthetic construct
GGSGSS

SEQ ID NO: 13305 - protein, 11 aa, synthetic construct
GGGGGSEAAAK

SEQ ID NO: 13306 - protein, 8 aa, synthetic construct
GSSEAAAK

SEQ ID NO: 13307 - protein, 9 aa, synthetic construct
GGGGGSGSS

SEQ ID NO: 13308 - protein, 11 aa, synthetic construct
EAAAKGGSGSS

SEQ ID NO: 13309 - skipped

SEQ ID NO: 13310 - protein, 5 aa, synthetic construct
GGGGG

SEQ ID NO: 13311 - protein, 5 aa, synthetic construct
EAAAK

SEQ ID NO: 13312 - skipped

SEQ ID NO: 13313 - protein, 13 aa, synthetic construct
PAPAPAPAPAPAP

SEQ ID NO: 13314 - protein, 20 aa, synthetic construct
EAAAKEAAAKEAAAKEAAAK

SEQ ID NO: 13315 - protein, 15 aa, synthetic construct
EAAAKGGGGSEAAAK

SEQ ID NO: 13316 - protein, 9 aa, synthetic construct
PAPGGSGGG

SEQ ID NO: 13317 - protein, 9 aa, synthetic construct
GGSGGGPAP

SEQ ID NO: 13318 - protein, 11 aa, synthetic construct
GGGGSSEAAAK

SEQ ID NO: 13319 - protein, 9 aa, synthetic construct
PAPGGGGSS

SEQ ID NO: 13320 - protein, 12 aa, synthetic construct
GGSGGSGGSGGS

SEQ ID NO: 13321 - protein, 9 aa, synthetic construct
PAPGGSGGG

SEQ ID NO: 13322 - protein, 9 aa, synthetic construct
GSSPAPGGS

SEQ ID NO: 13323 - protein, 9 aa, synthetic construct
GSSGSSGSS

SEQ ID NO: 13324 - protein, 9 aa, synthetic construct
PAPGGGGGS

SEQ ID NO: 13325 - protein, 6 aa, synthetic construct
GSSPAP

SEQ ID NO: 13326 - protein, 6 aa, synthetic construct
GGSGGG

SEQ ID NO: 13327 - protein, 15 aa, synthetic construct
EAAAKGGGGSEAAAK

SEQ ID NO: 13328 - protein, 11 aa, synthetic construct
GGSPAPEAAAK

SEQ ID NO: 13329 - protein, 8 aa, synthetic construct
EAAAKPAP

SEQ ID NO: 13330 - protein, 30 aa, synthetic construct; identical to SEQ ID NO: 5112

SEQ ID NO: 13331 - protein, 11 aa, synthetic construct
EAAAKGGGGSS

SEQ ID NO: 13332 - protein, 10 aa, synthetic construct
EAAAKEAAAK

SEQ ID NO: 13333 - protein, 11 aa, synthetic construct
GSSEAAAKGGS

SEQ ID NO: 13334 - protein, 6 aa, synthetic construct
GGSPAP

SEQ ID NO: 13335 - protein, 20 aa, synthetic construct
EAAAKEAAAKEAAAKEAAAK

SEQ ID NO: 13336 - protein, 15 aa, synthetic construct
GSSGSSGSSGSSGSS

SEQ ID NO: 13337 - protein, 8 aa, synthetic construct
PAPEAAAK

SEQ ID NO: 13338 - protein, 9 aa, synthetic construct
GSSGGSPAP

SEQ ID NO: 13339 - protein, 9 aa, synthetic construct
GGGPAPGGS

SEQ ID NO: 13340 - protein, 11 aa, synthetic construct
EAAAKPAPGGS

SEQ ID NO: 13341 - protein, 10 aa, synthetic construct
GGGGSGGGGS

SEQ ID NO: 13342 - protein, 8 aa, synthetic construct
GGGEAAAK

SEQ ID NO: 13343 - protein, 11 aa, synthetic construct
EAAAKGGGGGS

SEQ ID NO: 13344 - protein, 9 aa, synthetic construct
GGSPAPGSS

SEQ ID NO: 13345 - protein, 11 aa, synthetic construct
GSSPAPEAAAK

SEQ ID NO: 13346 - protein, 12 aa, synthetic construct
GSAGSAAGSGEF

SEQ ID NO: 13347 - protein, 5 aa, synthetic construct
EAAAK

SEQ ID NO: 13348 - protein, 11 aa, synthetic construct
EAAAKGGGGSS

SEQ ID NO: 13349 - skipped

SEQ ID NO: 13350 - protein, 9 aa, synthetic construct
GGSGSSPAP

SEQ ID NO: 13351 - protein, 11 aa, synthetic construct
GGSEAAAKPAP

SEQ ID NO: 13352 - protein, 11 aa, synthetic construct
EAAAKGGSGSS

SEQ ID NO: 13353 - protein, 6 aa, synthetic construct
PAPGSS

SEQ ID NO: 13354 - protein, 11 aa, synthetic construct
PAPEAAAKGGG

SEQ ID NO: 13355 - protein, 46 aa, synthetic construct; identical to SEQ ID NO: 5217

SEQ ID NO: 13356 - protein, 9 aa, synthetic construct
GSSGSSGSS

SEQ ID NO: 13357 - protein, 6 aa, synthetic construct
PAPGGG

SEQ ID NO: 13358 - protein, 6 aa, synthetic construct
PAPGGS

SEQ ID NO: 13359 - protein, 6 aa, synthetic construct
GSSGGG

SEQ ID NO: 13360 - protein, 18 aa, synthetic construct
GSSGSSGSSGSSGSSGSS

SEQ ID NO: 13361 - skipped

SEQ ID NO: 13362 - protein, 11 aa, synthetic construct
EAAAKGSSPAP

SEQ ID NO: 13363 - protein, 12 aa, synthetic construct
GSSGSSGSSGSS

SEQ ID NO: 13364 - protein, 25 aa, synthetic construct
GGGGSGGGGSGGGGSGGGGSGGGGS

SEQ ID NO: 13365 - protein, 5 aa, synthetic construct
GGGGS

SEQ ID NO: 13366 - protein, 11 aa, synthetic construct
EAAAKGSSGGG

SEQ ID NO: 13367 - protein, 6 aa, synthetic construct
GGGGGG

SEQ ID NO: 13368 - protein, 11 aa, synthetic construct
GGSGSSEAAAK

SEQ ID NO: 13369 - protein, 11 aa, synthetic construct
GSSPAPEAAAK

SEQ ID NO: 13370 - protein, 10 aa, synthetic construct
GGGGSGGGGS

SEQ ID NO: 13371 - protein, 9 aa, synthetic construct
GSSGGGGGS

SEQ ID NO: 13372 - protein, 12 aa, synthetic construct
GSAGSAAGSGEF

SEQ ID NO: 13373 - protein, 11 aa, synthetic construct
GGGEAAAKGSS

SEQ ID NO: 13374 - protein, 46 aa, synthetic construct; identical to SEQ ID NO: 5217

SEQ ID NO: 13375 - protein, 9 aa, synthetic construct
PAPGGSGGG

SEQ ID NO: 13376 - protein, 25 aa, synthetic construct
EAAAKEAAAKEAAAKEAAAKEAAAK

SEQ ID NO: 13377 - protein, 9 aa, synthetic construct
GGSGSSPAP

SEQ ID NO: 13378 - protein, 6 aa, synthetic construct
GGGGGG

SEQ ID NO: 13379 - protein, 25 aa, synthetic construct
EAAAKEAAAKEAAAKEAAAKEAAAK

SEQ ID NO: 13380 - protein, 11 aa, synthetic construct
EAAAKGSSPAP

SEQ ID NO: 13381 - protein, 9 aa, synthetic construct
GGGPAPGGS

SEQ ID NO: 13382 - protein, 46 aa, synthetic construct; identical to SEQ ID NO: 5217

SEQ ID NO: 13383 - skipped

SEQ ID NO: 13384 - protein, 8 aa, synthetic construct
EAAAKGGS

SEQ ID NO: 13385 - protein, 11 aa, synthetic construct
GSSGGSEAAAK

SEQ ID NO: 13386 - protein, 11 aa, synthetic construct
GGSGSSEAAAK

SEQ ID NO: 13387 - protein, 15 aa, synthetic construct
EAAAKEAAAKEAAAK

SEQ ID NO: 13388 - protein, 11 aa, synthetic construct
GGSGGGEAAAK

SEQ ID NO: 13389 - protein, 20 aa, synthetic construct
GGGGSGGGGSGGGGSGGGGS

SEQ ID NO: 13390 - protein, 8 aa, synthetic construct
EAAAKGSS

SEQ ID NO: 13391 - protein, 9 aa, synthetic construct
GSSGGGGGS

SEQ ID NO: 13392 - protein, 18 aa, synthetic construct
GSSGSSGSSGSSGSSGSS

SEQ ID NO: 13393 - protein, 6 aa, synthetic construct
GGSGSS

SEQ ID NO: 13394 - protein, 15 aa, synthetic construct
EAAAKGGGGSEAAAK

SEQ ID NO: 13395 - protein, 11 aa, synthetic construct
EAAAKGGGPAP

SEQ ID NO: 13396 - protein, 11 aa, synthetic construct
GGSEAAAKGGG

SEQ ID NO: 13397 - protein, 30 aa, synthetic construct; identical to SEQ ID NO: 5130

SEQ ID NO: 13398 - protein, 30 aa, synthetic construct; identical to SEQ ID NO: 5130

SEQ ID NO: 13399 - protein, 11 aa, synthetic construct
GSSPAPEAAAK

SEQ ID NO: 13400 - protein, 15 aa, synthetic construct
GGGGSEAAAKGGGGS

SEQ ID NO: 13401 - protein, 12 aa, synthetic construct
GSSGSSGSSGSS

SEQ ID NO: 13402 - protein, 8 aa, synthetic construct
GGSEAAAK

SEQ ID NO: 13403 - protein, 8 aa, synthetic construct
GGGGGGGG

SEQ ID NO: 13404 - protein, 6 aa, synthetic construct
GSSGGG

SEQ ID NO: 13405 - protein, 8 aa, synthetic construct
EAAAKGGS

SEQ ID NO: 13406 - protein, 5 aa, synthetic construct
GGGGS

SEQ ID NO: 13407 - protein, 11 aa, synthetic construct
GGSEAAAKGGG

SEQ ID NO: 13408 - protein, 9 aa, synthetic construct
GGSGSSGGG

SEQ ID NO: 13409 - protein, 11 aa, synthetic construct
GGSGSSEAAAK

SEQ ID NO: 13410 - protein, 11 aa, synthetic construct
EAAAKGGSGSS

SEQ ID NO: 13411 - skipped

SEQ ID NO: 13412 - protein, 9 aa, synthetic construct
GGGPAPGSS

SEQ ID NO: 13413 - protein, 15 aa, synthetic construct
GSSGSSGSSGSSGSS

SEQ ID NO: 13414 - protein, 11 aa, synthetic construct
GGGEAAAKPAP

SEQ ID NO: 13415 - protein, 6 aa, synthetic construct
GSSGGG

SEQ ID NO: 13416 - protein, 9 aa, synthetic construct
GGSPAPGSS

SEQ ID NO: 13417 - protein, 6 aa, synthetic construct
PAPGGS

SEQ ID NO: 13418 - protein, 11 aa, synthetic construct
PAPAPAPAPAP

SEQ ID NO: 13419 - protein, 6 aa, synthetic construct
GSSGGS

SEQ ID NO: 13420 - protein, 11 aa, synthetic construct
GSSGGSEAAAK

SEQ ID NO: 13421 - protein, 11 aa, synthetic construct
EAAAKGSSGGS

SEQ ID NO: 13422 - protein, 8 aa, synthetic construct
EAAAKGGG

SEQ ID NO: 13423 - protein, 9 aa, synthetic construct
PAPGGGGGS

SEQ ID NO: 13424 - protein, 15 aa, synthetic construct
GGGGSEAAAKGGGGS

SEQ ID NO: 13425 - protein, 30 aa, synthetic construct; identical to SEQ ID NO: 5130

SEQ ID NO: 13426 - skipped

SEQ ID NO: 13427 - protein, 9 aa, synthetic construct
GSSGGSPAP

SEQ ID NO: 13428 - skipped

SEQ ID NO: 13429 - protein, 6 aa, synthetic construct
PAPGSS

SEQ ID NO: 13430 - protein, 11 aa, synthetic construct
GGSEAAAKGGG

SEQ ID NO: 13431 - protein, 11 aa, synthetic construct
GGSEAAAKPAP

SEQ ID NO: 13432 - protein, 9 aa, synthetic construct
GGGGSSPAP

SEQ ID NO: 13433 - protein, 25 aa, synthetic construct
EAAAKEAAAKEAAAKEAAAKEAAAK

SEQ ID NO: 13434 - protein, 4 aa, synthetic construct
GGGG

SEQ ID NO: 13435 - protein, 11 aa, synthetic construct
GGSEAAAKPAP

SEQ ID NO: 13436 - protein, 9 aa, synthetic construct
PAPGSSGGG

SEQ ID NO: 13437 - protein, 11 aa, synthetic construct
PAPEAAAKGGS

SEQ ID NO: 13438 - protein, 9 aa, synthetic construct
GGGGSSPAP

SEQ ID NO: 13439 - protein, 20 aa, synthetic construct
GGGGSGGGGSGGGGSGGGGS

SEQ ID NO: 13440 - protein, 8 aa, synthetic construct
GGGEAAAK

SEQ ID NO: 13441 - protein, 6 aa, synthetic construct
GGGGSS

SEQ ID NO: 13442 - protein, 9 aa, synthetic construct
GGSPAPGSS

SEQ ID NO: 13443 - protein, 5 aa, synthetic construct
GGGGS

SEQ ID NO: 13444 - protein, 11 aa, synthetic construct
EAAAKGSSGGS

SEQ ID NO: 13445 - skipped

SEQ ID NO: 13446 - protein, 4 aa, synthetic construct
GGGG

SEQ ID NO: 13447 - protein, 6 aa, synthetic construct
GSSGGS

SEQ ID NO: 13448 - protein, 12 aa, synthetic construct
GGSGGSGGSGGS

SEQ ID NO: 13449 - protein, 11 aa, synthetic construct
PAPEAAAKGGS

SEQ ID NO: 13450 - protein, 11 aa, synthetic construct
EAAAKGSSGGG

SEQ ID NO: 13451 - protein, 8 aa, synthetic construct
GSSEAAAK

SEQ ID NO: 13452 - protein, 12 aa, synthetic construct
GSAGSAAGSGEF

SEQ ID NO: 13453 - protein, 11 aa, synthetic construct
GGGGGSEAAAK

SEQ ID NO: 13454 - protein, 4 aa, synthetic construct
GGGG

SEQ ID NO: 13455 - protein, 11 aa, synthetic construct
GGGGSSEAAAK

SEQ ID NO: 13456 - protein, 6 aa, synthetic construct
PAPGGG

SEQ ID NO: 13457 - protein, 11 aa, synthetic construct
EAAAKGGSGGG

SEQ ID NO: 13458 - protein, 9 aa, synthetic construct
GGGPAPGGS

SEQ ID NO: 13459 - protein, 8 aa, synthetic construct
EAAAKPAP

SEQ ID NO: 13460 - protein, 9 aa, synthetic construct
GSSGSSGSS

SEQ ID NO: 13461 - protein, 9 aa, synthetic construct
GSSPAPGGS

SEQ ID NO: 13462 - protein, 9 aa, synthetic construct
GGGGGSPAP

SEQ ID NO: 13463 - protein, 9 aa, synthetic construct
GGSGSSGGG

SEQ ID NO: 13464 - protein, 11 aa, synthetic construct
GGGEAAAKGSS

SEQ ID NO: 13465 - protein, 8 aa, synthetic construct
GSSEAAAK

SEQ ID NO: 13466 - protein, 5 aa, synthetic construct
EAAAK

SEQ ID NO: 13467 - protein, 11 aa, synthetic construct
EAAAKGGSGSS

SEQ ID NO: 13468 - protein, 11 aa, synthetic construct
GSSEAAAKGGG

SEQ ID NO: 13469 - protein, 9 aa, synthetic construct
PAPGSSGGG

SEQ ID NO: 13470 - protein, 11 aa, synthetic construct
EAAAKGGGGGS

SEQ ID NO: 13471 - protein, 11 aa, synthetic construct
GGSEAAAKPAP

SEQ ID NO: 13472 - protein, 9 aa, synthetic construct
GGGPAPGGS

SEQ ID NO: 13473 - protein, 5 aa, synthetic construct
GGGGS

SEQ ID NO: 13474 - protein, 15 aa, synthetic construct
GGSGGSGGSGGSGGS

SEQ ID NO: 13475 - protein, 6 aa, synthetic construct
GGGPAP

SEQ ID NO: 13476 - protein, 8 aa, synthetic construct
EAAAKPAP

SEQ ID NO: 13477 - protein, 8 aa, synthetic construct
GGSEAAAK

SEQ ID NO: 13478 - protein, 11 aa, synthetic construct
GSSEAAAKPAP

SEQ ID NO: 13479 - protein, 6 aa, synthetic construct
GGSGSS

SEQ ID NO: 13480 - protein, 11 aa, synthetic construct
EAAAKPAPGGG

SEQ ID NO: 13481 - protein, 11 aa, synthetic construct
GGSPAPEAAAK

SEQ ID NO: 13482 - protein, 11 aa, synthetic construct
GGSEAAAKGGG

SEQ ID NO: 13483 - protein, 15 aa, synthetic construct
GGGGSEAAAKGGGGS

SEQ ID NO: 13484 - protein, 11 aa, synthetic construct
GSSGGGEAAAK

SEQ ID NO: 13485 - protein, 11 aa, synthetic construct
EAAAKGGGPAP

SEQ ID NO: 13486 - protein, 6 aa, synthetic construct
GSSPAP

SEQ ID NO: 13487 - protein, 46 aa, synthetic construct; identical to SEQ ID NO: 5217

SEQ ID NO: 13488 - protein, 11 aa, synthetic construct
GGSEAAAKGSS

SEQ ID NO: 13489 - protein, 11 aa, synthetic construct
GSSGGSEAAAK

SEQ ID NO: 13490 - protein, 11 aa, synthetic construct
GGSEAAAKGSS

SEQ ID NO: 13491 - protein, 8 aa, synthetic construct
EAAAKGGG

SEQ ID NO: 13492 - protein, 11 aa, synthetic construct
GSSGGSEAAAK

SEQ ID NO: 13493 - protein, 15 aa, synthetic construct
GGGGSEAAAKGGGGS

SEQ ID NO: 13494 - protein, 11 aa, synthetic construct
PAPGSSEAAAK

SEQ ID NO: 13495 - protein, 8 aa, synthetic construct
PAPEAAAK

SEQ ID NO: 13496 - protein, 9 aa, synthetic construct
PAPGGSGSS

SEQ ID NO: 13497 - protein, 6 aa, synthetic construct
PAPGSS

SEQ ID NO: 13498 - protein, 9 aa, synthetic construct
PAPGGGGGS

SEQ ID NO: 13499 - protein, 11 aa, synthetic construct
EAAAKPAPGSS

SEQ ID NO: 13500 - protein, 9 aa, synthetic construct
GSSPAPGGS

SEQ ID NO: 13501 - protein, 11 aa, synthetic construct
GGSGSSEAAAK

SEQ ID NO: 13502 - protein, 6 aa, synthetic construct
GGGGGG

SEQ ID NO: 13503 - protein, 20 aa, synthetic construct
EAAAKEAAAKEAAAKEAAAK

SEQ ID NO: 13504 - protein, 9 aa, synthetic construct
GGSPAPGSS

SEQ ID NO: 13505 - protein, 11 aa, synthetic construct
PAPAPAPAPAP

SEQ ID NO: 13506 - protein, 9 aa, synthetic construct
GGSGSSPAP

SEQ ID NO: 13507 - protein, 11 aa, synthetic construct
EAAAKGGSGGG

SEQ ID NO: 13508 - protein, 15 aa, synthetic construct
GSSGSSGSSGSSGSS

SEQ ID NO: 13509 - protein, 46 aa, synthetic construct; identical to SEQ ID NO: 5217

SEQ ID NO: 13510 - protein, 11 aa, synthetic construct
GSSGGGEAAAK

SEQ ID NO: 13511 - protein, 11 aa, synthetic construct
GSSGGSEAAAK

SEQ ID NO: 13512 - protein, 8 aa, synthetic construct
GGGGGGGG

SEQ ID NO: 13513 - protein, 11 aa, synthetic construct
PAPGGSEAAAK

SEQ ID NO: 13514 - protein, 9 aa, synthetic construct
GGGGSSPAP

SEQ ID NO: 13515 - protein, 9 aa, synthetic construct
PAPAPAPAP

SEQ ID NO: 13516 - protein, 11 aa, synthetic construct
GGSEAAAKPAP

SEQ ID NO: 13517 - protein, 9 aa, synthetic construct
PAPGGSGGG

SEQ ID NO: 13518 - protein, 30 aa, synthetic construct; identical to SEQ ID NO: 5130

SEQ ID NO: 13519 - protein, 15 aa, synthetic construct
GGGGSGGGGSGGGGS

SEQ ID NO: 13520 - protein, 9 aa, synthetic construct
GGSGGGPAP

SEQ ID NO: 13521 - protein, 11 aa, synthetic construct
GGGPAPEAAAK

SEQ ID NO: 13522 - protein, 9 aa, synthetic construct
GGGGGSGSS

SEQ ID NO: 13523 - skipped

SEQ ID NO: 13524 - protein, 9 aa, synthetic construct
GGGGGSPAP

SEQ ID NO: 13525 - protein, 6 aa, synthetic construct
GGSPAP

SEQ ID NO: 13526 - protein, 9 aa, synthetic construct
GGGPAPGGS

SEQ ID NO: 13527 - protein, 9 aa, synthetic construct
PAPGSSGGG

SEQ ID NO: 13528 - protein, 9 aa, synthetic construct
PAPGSSGGG

SEQ ID NO: 13529 - protein, 6 aa, synthetic construct
PAPGGS

SEQ ID NO: 13530 - protein, 11 aa, synthetic construct
GGGEAAAKGSS

SEQ ID NO: 13531 - protein, 11 aa, synthetic construct
GGSEAAAKGSS

SEQ ID NO: 13532 - protein, 11 aa, synthetic construct
PAPGGSEAAAK

SEQ ID NO: 13533 - protein, 11 aa, synthetic construct
GGSEAAAKGGG

SEQ ID NO: 13534 - protein, 9 aa, synthetic construct
GGSGGGGSS

SEQ ID NO: 13535 - protein, 11 aa, synthetic construct
GGGEAAAKPAP

SEQ ID NO: 13536 - protein, 8 aa, synthetic construct
EAAAKGSS

SEQ ID NO: 13537 - protein, 11 aa, synthetic construct
PAPEAAAKGSS

SEQ ID NO: 13538 - protein, 12 aa, synthetic construct
GSAGSAAGSGEF

SEQ ID NO: 13539 - protein, 11 aa, synthetic construct
EAAAKGGGGGS

SEQ ID NO: 13540 - protein, 11 aa, synthetic construct
EAAAKGSSPAP

SEQ ID NO: 13541 - protein, 15 aa, synthetic construct
GGGGSEAAAKGGGGS

SEQ ID NO: 13542 - protein, 11 aa, synthetic construct
GSSEAAAKPAP

SEQ ID NO: 13543 - protein, 6 aa, synthetic construct
GGGGGG

SEQ ID NO: 13544 - protein, 6 aa, synthetic construct
PAPGGS

SEQ ID NO: 13545 - skipped

SEQ ID NO: 13546 - protein, 7 aa, synthetic construct
PAPAPAP

SEQ ID NO: 13547 - protein, 4 aa, synthetic construct
GGGG

SEQ ID NO: 13548 - protein, 11 aa, synthetic construct
GSSGGSEAAAK

SEQ ID NO: 13549 - protein, 9 aa, synthetic construct
GGSGGGGSS

SEQ ID NO: 13550 - protein, 9 aa, synthetic construct
GGGGSSGGS

SEQ ID NO: 13551 - protein, 9 aa, synthetic construct
GSSPAPGGG

SEQ ID NO: 13552 - protein, 11 aa, synthetic construct
GGSEAAAKPAP

SEQ ID NO: 13553 - skipped

SEQ ID NO: 13554 - protein, 6 aa, synthetic construct
GSSGGS

SEQ ID NO: 13555 - protein, 5 aa, synthetic construct
GGGGG

SEQ ID NO: 13556 - protein, 9 aa, synthetic construct
GSSGGGPAP

SEQ ID NO: 13557 - protein, 11 aa, synthetic construct
GSSEAAAKGGG

SEQ ID NO: 13558 - protein, 30 aa, synthetic construct; identical to SEQ ID NO: 5130

SEQ ID NO: 13559 - protein, 11 aa, synthetic construct
GGSEAAAKPAP

SEQ ID NO: 13560 - protein, 13 aa, synthetic construct
PAPAPAPAPAPAP

SEQ ID NO: 13561 - protein, 15 aa, synthetic construct
GGGGSEAAAKGGGGS

SEQ ID NO: 13562 - protein, 11 aa, synthetic construct
EAAAKPAPGSS

SEQ ID NO: 13563 - protein, 15 aa, synthetic construct
GSSGSSGSSGSSGSS

SEQ ID NO: 13564 - protein, 11 aa, synthetic construct
PAPEAAAKGSS

SEQ ID NO: 13565 - protein, 46 aa, synthetic construct; identical to SEQ ID NO: 5217

SEQ ID NO: 13566 - protein, 46 aa, synthetic construct; identical to SEQ ID NO: 5217

SEQ ID NO: 13567 - protein, 11 aa, synthetic construct
GGSEAAAKGGG

SEQ ID NO: 13568 - protein, 9 aa, synthetic construct
GGSGGGGSS

SEQ ID NO: 13569 - protein, 11 aa, synthetic construct
PAPEAAAKGSS

SEQ ID NO: 13570 - skipped

SEQ ID NO: 13571 - protein, 11 aa, synthetic construct
GGSGGGEAAAK

SEQ ID NO: 13572 - protein, 11 aa, synthetic construct
EAAAKGGGGSS

SEQ ID NO: 13573 - protein, 9 aa, synthetic construct
GSSPAPGGG

SEQ ID NO: 13574 - protein, 11 aa, synthetic construct
EAAAKGSSGGG

SEQ ID NO: 13575 - protein, 11 aa, synthetic construct
GGSGGGEAAAK

SEQ ID NO: 13576 - protein, 15 aa, synthetic construct
GGSGGSGGSGGSGGS

SEQ ID NO: 13577 - protein, 11 aa, synthetic construct
EAAAKPAPGGS

SEQ ID NO: 13578 - protein, 11 aa, synthetic construct
GGGGGSEAAAK

SEQ ID NO: 13579 - protein, 6 aa, synthetic construct
GSSPAP

SEQ ID NO: 13580 - protein, 11 aa, synthetic construct
GGGEAAAKPAP

SEQ ID NO: 13581 - protein, 11 aa, synthetic construct
GSSGGSEAAAK

SEQ ID NO: 13582 - protein, 11 aa, synthetic construct
EAAAKPAPGGS

SEQ ID NO: 13583 - protein, 6 aa, synthetic construct
PAPGGG

SEQ ID NO: 13584 - protein, 11 aa, synthetic construct
EAAAKGSSPAP

SEQ ID NO: 13585 - protein, 11 aa, synthetic construct
GSSPAPEAAAK

SEQ ID NO: 13586 - protein, 11 aa, synthetic construct
GGSGGGEAAAK

SEQ ID NO: 13587 - protein, 9 aa, synthetic construct
GSSGSSGSS

SEQ ID NO: 13588 - protein, 8 aa, synthetic construct
EAAAKGGS

SEQ ID NO: 13589 - protein, 11 aa, synthetic construct
EAAAKPAPGGS

SEQ ID NO: 13590 - protein, 11 aa, synthetic construct
EAAAKPAPGGS

SEQ ID NO: 13591 - protein, 9 aa, synthetic construct
GSSGGGGGS

SEQ ID NO: 13592 - protein, 9 aa, synthetic construct
PAPGGGGSS

SEQ ID NO: 13593 - protein, 9 aa, synthetic construct
GSSGSSGSS

SEQ ID NO: 13594 - protein, 20 aa, synthetic construct
EAAAKEAAAKEAAAKEAAAK

SEQ ID NO: 13595 - skipped

SEQ ID NO: 13596 - protein, 11 aa, synthetic construct
EAAAKPAPGSS

SEQ ID NO: 13597 - protein, 8 aa, synthetic construct
EAAAKGGG

SEQ ID NO: 13598 - protein, 11 aa, synthetic construct
PAPGSSEAAAK

SEQ ID NO: 13599 - protein, 9 aa, synthetic construct
PAPGSSGGS

SEQ ID NO: 13600 - protein, 11 aa, synthetic construct
GSSPAPEAAAK

SEQ ID NO: 13601 - protein, 18 aa, synthetic construct
GSSGSSGSSGSSGSSGSS

SEQ ID NO: 13602 - protein, 5 aa, synthetic construct
GGGGS

SEQ ID NO: 13603 - protein, 6 aa, synthetic construct
GSSPAP

SEQ ID NO: 13604 - protein, 15 aa, synthetic construct
EAAAKGGGGSEAAAK

SEQ ID NO: 13605 - protein, 10 aa, synthetic construct
EAAAKEAAAK

SEQ ID NO: 13606 - protein, 9 aa, synthetic construct
GGGGSSGGS

SEQ ID NO: 13607 - protein, 11 aa, synthetic construct
PAPGGSEAAAK

SEQ ID NO: 13608 - protein, 11 aa, synthetic construct
EAAAKGGSPAP

SEQ ID NO: 13609 - protein, 9 aa, synthetic construct
GSSGGSGGG

SEQ ID NO: 13610 - protein, 6 aa, synthetic construct
GSSGGS

SEQ ID NO: 13611 - protein, 9 aa, synthetic construct
PAPGGSGSS

SEQ ID NO: 13612 - protein, 11 aa, synthetic construct
EAAAKGGSGSS

SEQ ID NO: 13613 - protein, 5 aa, synthetic construct
PAPAP

SEQ ID NO: 13614 - protein, 11 aa, synthetic construct
EAAAKGSSPAP

SEQ ID NO: 13615 - protein, 11 aa, synthetic construct
EAAAKPAPGGG

SEQ ID NO: 13616 - protein, 30 aa, synthetic construct; identical to SEQ ID NO: 5112

SEQ ID NO: 13617 - protein, 11 aa, synthetic construct
EAAAKGGGGSS

SEQ ID NO: 13618 - protein, 8 aa, synthetic construct
PAPEAAAK

SEQ ID NO: 13619 - protein, 11 aa, synthetic construct
EAAAKPAPGSS

SEQ ID NO: 13620 - protein, 6 aa, synthetic construct
GGSPAP

SEQ ID NO: 13621 - protein, 6 aa, synthetic construct
GGSGGS

SEQ ID NO: 13622 - protein, 11 aa, synthetic construct
PAPEAAAKGSS

SEQ ID NO: 13623 - protein, 6 aa, synthetic construct
PAPGSS

SEQ ID NO: 13624 - protein, 11 aa, synthetic construct
PAPAPAPAPAP

SEQ ID NO: 13625 - skipped

SEQ ID NO: 13626 - protein, 6 aa, synthetic construct
GGGPAP

SEQ ID NO: 13627 - protein, 11 aa, synthetic construct
GSSPAPEAAAK

SEQ ID NO: 13628 - skipped

SEQ ID NO: 13629 - protein, 6 aa, synthetic construct
GGSPAP

SEQ ID NO: 13630 - protein, 11 aa, synthetic construct
PAPEAAAKGGS

SEQ ID NO: 13631 - protein, 9 aa, synthetic construct
PAPGSSGGS

SEQ ID NO: 13632 - protein, 13 aa, synthetic construct
PAPAPAPAPAPAP

SEQ ID NO: 13633 - protein, 15 aa, synthetic construct
EAAAKEAAAKEAAAK

SEQ ID NO: 13634 - protein, 15 aa, synthetic construct
GGSGGSGGSGGSGGS

SEQ ID NO: 13635 - protein, 11 aa, synthetic construct
EAAAKPAPGGS

SEQ ID NO: 13636 - protein, 6 aa, synthetic construct
GGSGGS

SEQ ID NO: 13637 - protein, 8 aa, synthetic construct
EAAAKPAP

SEQ ID NO: 13638 - protein, 8 aa, synthetic construct
GGSEAAAK

SEQ ID NO: 13639 - protein, 6 aa, synthetic construct
GGSGGG

SEQ ID NO: 13640 - protein, 11 aa, synthetic construct
GGSGGGEAAAK

SEQ ID NO: 13641 - protein, 11 aa, synthetic construct
PAPEAAAKGGG

SEQ ID NO: 13642 - protein, 5 aa, synthetic construct
PAPAP

SEQ ID NO: 13643 - skipped

SEQ ID NO: 13644 - protein, 11 aa, synthetic construct
EAAAKGSSGGG

SEQ ID NO: 13645 - protein, 9 aa, synthetic construct
GGSPAPGSS

SEQ ID NO: 13646 - protein, 8 aa, synthetic construct
PAPEAAAK

SEQ ID NO: 13647 - protein, 11 aa, synthetic construct
EAAAKGGSPAP

SEQ ID NO: 13648 - protein, 9 aa, synthetic construct
PAPAPAPAP

SEQ ID NO: 13649 - protein, 11 aa, synthetic construct
PAPGGSEAAAK

SEQ ID NO: 13650 - protein, 12 aa, synthetic construct
GGSGGSGGSGGS

SEQ ID NO: 13651 - protein, 9 aa, synthetic construct
GGGGGSGSS

SEQ ID NO: 13652 - protein, 9 aa, synthetic construct
PAPGGSGGG

SEQ ID NO: 13653 - skipped

SEQ ID NO: 13654 - protein, 5 aa, synthetic construct
EAAAK

SEQ ID NO: 13655 - protein, 11 aa, synthetic construct
GGGEAAAKGSS

SEQ ID NO: 13656 - protein, 9 aa, synthetic construct
GGSPAPGSS

SEQ ID NO: 13657 - protein, 11 aa, synthetic construct
GGSEAAAKPAP

SEQ ID NO: 13658 - protein, 25 aa, synthetic construct
GGGGSGGGGSGGGGSGGGGSGGGGS

SEQ ID NO: 13659 - protein, 6 aa, synthetic construct
GGSGSS

SEQ ID NO: 13660 - protein, 11 aa, synthetic construct
GGGEAAAKGSS

SEQ ID NO: 13661 - protein, 11 aa, synthetic construct
EAAAKGGSPAP

SEQ ID NO: 13662 - protein, 11 aa, synthetic construct
GSSPAPEAAAK

SEQ ID NO: 13663 - protein, 12 aa, synthetic construct
GGSGGSGGSGGS

SEQ ID NO: 13664 - protein, 11 aa, synthetic construct
GSSPAPEAAAK

SEQ ID NO: 13665 - protein, 12 aa, synthetic construct
GSSGSSGSSGSS

SEQ ID NO: 13666 - protein, 11 aa, synthetic construct
GGSGSSEAAAK

SEQ ID NO: 13667 - protein, 6 aa, synthetic construct
GGSGGG

SEQ ID NO: 13668 - protein, 9 aa, synthetic construct
GGSPAPGGG

SEQ ID NO: 13669 - protein, 9 aa, synthetic construct
GGSGGSGGS

SEQ ID NO: 13670 - protein, 11 aa, synthetic construct
GGGGSSEAAAK

SEQ ID NO: 13671 - protein, 9 aa, synthetic construct
GGSPAPGSS

SEQ ID NO: 13672 - protein, 11 aa, synthetic construct
EAAAKPAPGSS

SEQ ID NO: 13673 - protein, 9 aa, synthetic construct
GGGGSSGGS

SEQ ID NO: 13674 - protein, 11 aa, synthetic construct
GGSPAPEAAAK

SEQ ID NO: 13675 - protein, 8 aa, synthetic construct
GGSEAAAK

SEQ ID NO: 13676 - protein, 12 aa, synthetic construct
GSSGSSGSSGSS

SEQ ID NO: 13677 - protein, 25 aa, synthetic construct
EAAAKEAAAKEAAAKEAAAKEAAAK

SEQ ID NO: 13678 - protein, 5 aa, synthetic construct
GGGGG

SEQ ID NO: 13679 - protein, 11 aa, synthetic construct
GGSEAAAKGSS

SEQ ID NO: 13680 - protein, 6 aa, synthetic construct
GSSGGG

SEQ ID NO: 13681 - protein, 9 aa, synthetic construct
PAPGSSGGG

SEQ ID NO: 13682 - protein, 6 aa, synthetic construct
GGSGGS

SEQ ID NO: 13683 - protein, 11 aa, synthetic construct
EAAAKGGGGGS

SEQ ID NO: 13684 - protein, 9 aa, synthetic construct
GGSGSSPAP

SEQ ID NO: 13685 - protein, 9 aa, synthetic construct
PAPGSSGGG

SEQ ID NO: 13686 - protein, 9 aa, synthetic construct
PAPGGSGGG

SEQ ID NO: 13687 - protein, 4 aa, synthetic construct
GGGG

SEQ ID NO: 13688 - protein, 11 aa, synthetic construct
EAAAKGGSPAP

SEQ ID NO: 13689 - protein, 6 aa, synthetic construct
GSSGSS

SEQ ID NO: 13690 - protein, 11 aa, synthetic construct
GGSEAAAKPAP

SEQ ID NO: 13691 - protein, 11 aa, synthetic construct
EAAAKGSSGGS

SEQ ID NO: 13692 - protein, 46 aa, synthetic construct; identical to SEQ ID NO: 5217

SEQ ID NO: 13693 - protein, 11 aa, synthetic construct
EAAAKGGSGSS

SEQ ID NO: 13694 - protein, 5 aa, synthetic construct
GGGGG

SEQ ID NO: 13695 - protein, 8 aa, synthetic construct
GGGEAAAK

SEQ ID NO: 13696 - protein, 12 aa, synthetic construct
GGSGGSGGSGGS

SEQ ID NO: 13697 - protein, 30 aa, synthetic construct; identical to SEQ ID NO: 5130

SEQ ID NO: 13698 - protein, 11 aa, synthetic construct
PAPAPAPAPAP

SEQ ID NO: 13699 - protein, 10 aa, synthetic construct
EAAAKEAAAK

SEQ ID NO: 13700 - protein, 11 aa, synthetic construct
GSSGGSEAAAK

SEQ ID NO: 13701 - protein, 11 aa, synthetic construct
PAPGGSEAAAK

SEQ ID NO: 13702 - protein, 11 aa, synthetic construct
EAAAKGGGPAP

SEQ ID NO: 13703 - protein, 9 aa, synthetic construct
PAPGGSGSS

SEQ ID NO: 13704 - protein, 16 aa, synthetic construct
SGSETPGTSESATPES

SEQ ID NO: 13705 - protein, 6 aa, synthetic construct
GGSGGS

SEQ ID NO: 13706 - protein, 8 aa, synthetic construct
EAAAKGGS

SEQ ID NO: 13707 - protein, 9 aa, synthetic construct
GGSPAPGSS

SEQ ID NO: 13708 - protein, 20 aa, synthetic construct
EAAAKEAAAKEAAAKEAAAK

SEQ ID NO: 13709 - protein, 9 aa, synthetic construct
GSSGGSGGG

SEQ ID NO: 13710 - protein, 11 aa, synthetic construct
PAPGSSEAAAK

SEQ ID NO: 13711 - protein, 13 aa, synthetic construct
PAPAPAPAPAPAP

SEQ ID NO: 13712 - protein, 6 aa, synthetic construct
GGGGSS

SEQ ID NO: 13713 - protein, 15 aa, synthetic construct
GGGGSEAAAKGGGGS

SEQ ID NO: 13714 - protein, 11 aa, synthetic construct
GSSPAPEAAAK

SEQ ID NO: 13715 - protein, 11 aa, synthetic construct
PAPEAAAKGGG

SEQ ID NO: 13716 - protein, 10 aa, synthetic construct
EAAAKEAAAK

SEQ ID NO: 13717 - protein, 5 aa, synthetic construct
EAAAK

SEQ ID NO: 13718 - protein, 9 aa, synthetic construct
GSSGGSGGG

SEQ ID NO: 13719 - protein, 11 aa, synthetic construct
GGGEAAAKPAP

SEQ ID NO: 13720 - protein, 6 aa, synthetic construct
GGSGGS

SEQ ID NO: 13721 - protein, 30 aa, synthetic construct; identical to SEQ ID NO: 5130

SEQ ID NO: 13722 - protein, 5 aa, synthetic construct
GGGGG

SEQ ID NO: 13723 - protein, 11 aa, synthetic construct
GSSGGSEAAAK

SEQ ID NO: 13724 - protein, 33 aa, synthetic construct; identical to SEQ ID NO: 5006

SEQ ID NO: 13725 - protein, 9 aa, synthetic construct
GGSGGGPAP

SEQ ID NO: 13726 - protein, 6 aa, synthetic construct
GGSGSS

SEQ ID NO: 13727 - protein, 16 aa, synthetic construct
SGSETPGTSESATPES

SEQ ID NO: 13728 - protein, 11 aa, synthetic construct
EAAAKGGSPAP

SEQ ID NO: 13729 - protein, 5 aa, synthetic construct
PAPAP

SEQ ID NO: 13730 - protein, 46 aa, synthetic construct; identical to SEQ ID NO: 5217

SEQ ID NO: 13731 - protein, 6 aa, synthetic construct
GGGGGS

SEQ ID NO: 13732 - protein, 10 aa, synthetic construct
EAAAKEAAAK

SEQ ID NO: 13733 - protein, 11 aa, synthetic construct
GSSGGSEAAAK

SEQ ID NO: 13734 - protein, 8 aa, synthetic construct
GGGEAAAK

SEQ ID NO: 13735 - protein, 11 aa, synthetic construct
GSSGGGEAAAK

SEQ ID NO: 13736 - skipped

SEQ ID NO: 13737 - protein, 15 aa, synthetic construct
GGGGSEAAAKGGGGS

SEQ ID NO: 13738 - protein, 4 aa, synthetic construct
GGGG

SEQ ID NO: 13739 - protein, 6 aa, synthetic construct
GGSGGS

SEQ ID NO: 13740 - protein, 9 aa, synthetic construct
GGSGGGGSS

SEQ ID NO: 13741 - protein, 9 aa, synthetic construct
GSSPAPGGS

SEQ ID NO: 13742 - protein, 11 aa, synthetic construct
GSSPAPEAAAK

SEQ ID NO: 13743 - protein, 8 aa, synthetic construct
EAAAKGGS

SEQ ID NO: 13744 - protein, 12 aa, synthetic construct
GGSGGSGGSGGS

SEQ ID NO: 13745 - protein, 11 aa, synthetic construct
GGGGSSEAAAK

SEQ ID NO: 13746 - protein, 13 aa, synthetic construct
PAPAPAPAPAPAP

SEQ ID NO: 13747 - protein, 11 aa, synthetic construct
EAAAKGSSGGG

SEQ ID NO: 13748 - protein, 5 aa, synthetic construct
GGGGG

SEQ ID NO: 13749 - protein, 46 aa, synthetic construct; identical to SEQ ID NO: 5217

SEQ ID NO: 13750 - protein, 33 aa, synthetic construct; identical to SEQ ID NO: 5006

SEQ ID NO: 13751 - protein, 9 aa, synthetic construct
GGSPAPGGG

SEQ ID NO: 13752 - protein, 11 aa, synthetic construct
GGGEAAAKGGS

SEQ ID NO: 13753 - protein, 8 aa, synthetic construct
GGGEAAAK

SEQ ID NO: 13754 - protein, 11 aa, synthetic construct
PAPEAAAKGGG

SEQ ID NO: 13755 - protein, 18 aa, synthetic construct
GSSGSSGSSGSSGSSGSS

SEQ ID NO: 13756 - protein, 46 aa, synthetic construct; identical to SEQ ID NO: 5217

SEQ ID NO: 13757 - protein, 11 aa, synthetic construct
EAAAKGGSPAP

SEQ ID NO: 13758 - protein, 10 aa, synthetic construct
EAAAKEAAAK

SEQ ID NO: 13759 - protein, 30 aa, synthetic construct; identical to SEQ ID NO: 5112

SEQ ID NO: 13760 - protein, 12 aa, synthetic construct
GGSGGSGGSGGS

SEQ ID NO: 13761 - protein, 25 aa, synthetic construct
EAAAKEAAAKEAAAKEAAAKEAAAK

SEQ ID NO: 13762 - protein, 18 aa, synthetic construct
GSSGSSGSSGSSGSSGSS

SEQ ID NO: 13763 - protein, 5 aa, synthetic construct
GGGGS

SEQ ID NO: 13764 - protein, 46 aa, synthetic construct; identical to SEQ ID NO: 5217

SEQ ID NO: 13765 - protein, 10 aa, synthetic construct
GGGGSGGGGS

SEQ ID NO: 13766 - protein, 10 aa, synthetic construct
GGGGSGGGGS

SEQ ID NO: 13767 - protein, 6 aa, synthetic construct
GGSGSS

SEQ ID NO: 13768 - protein, 9 aa, synthetic construct
GSSPAPGGG

SEQ ID NO: 13769 - protein, 9 aa, synthetic construct
GSSGGSPAP

SEQ ID NO: 13770 - protein, 6 aa, synthetic construct
PAPGGS

SEQ ID NO: 13771 - protein, 11 aa, synthetic construct
GGSPAPEAAAK

SEQ ID NO: 13772 - protein, 9 aa, synthetic construct
GGGPAPGGS

SEQ ID NO: 13773 - protein, 9 aa, synthetic construct
PAPGSSGGG

SEQ ID NO: 13774 - protein, 11 aa, synthetic construct
GSSGGGEAAAK

SEQ ID NO: 13775 - protein, 6 aa, synthetic construct
GSSGGG

SEQ ID NO: 13776 - protein, 6 aa, synthetic construct
GSSGSS

SEQ ID NO: 13777 - protein, 6 aa, synthetic construct
GSSGGG

SEQ ID NO: 13778 - protein, 9 aa, synthetic construct
PAPGGGGGS

SEQ ID NO: 13779 - protein, 8 aa, synthetic construct
GSSEAAAK

SEQ ID NO: 13780 - protein, 6 aa, synthetic construct
PAPGGG

SEQ ID NO: 13781 - protein, 10 aa, synthetic construct
GGGGSGGGGS

SEQ ID NO: 13782 - protein, 6 aa, synthetic construct
GSSGGS

SEQ ID NO: 13783 - protein, 10 aa, synthetic construct
GGGGSGGGGS

SEQ ID NO: 13784 - protein, 11 aa, synthetic construct
EAAAKGGSGSS

SEQ ID NO: 13785 - protein, 11 aa, synthetic construct
GSSEAAAKGGS

SEQ ID NO: 13786 - protein, 11 aa, synthetic construct
PAPGSSEAAAK

SEQ ID NO: 13787 - protein, 10 aa, synthetic construct
GGGGSGGGGS

SEQ ID NO: 13788 - protein, 11 aa, synthetic construct
PAPGSSEAAAK

SEQ ID NO: 13789 - protein, 11 aa, synthetic construct
PAPGSSEAAAK

SEQ ID NO: 13790 - protein, 9 aa, synthetic construct
GGSPAPGGG

SEQ ID NO: 13791 - protein, 6 aa, synthetic construct
GGGGGS

SEQ ID NO: 13792 - protein, 9 aa, synthetic construct
GGGGSSGGS

SEQ ID NO: 13793 - protein, 9 aa, synthetic construct
PAPAPAPAP

SEQ ID NO: 13794 - protein, 6 aa, synthetic construct
GGSGGS

SEQ ID NO: 13795 - protein, 9 aa, synthetic construct
GGGPAPGGS

SEQ ID NO: 13796 - protein, 15 aa, synthetic construct
GGSGGSGGSGGSGGS

SEQ ID NO: 13797 - protein, 6 aa, synthetic construct
GGSGGG

SEQ ID NO: 13798 - protein, 10 aa, synthetic construct
EAAAKEAAAK

SEQ ID NO: 13799 - protein, 6 aa, synthetic construct
PAPGSS

SEQ ID NO: 13800 - protein, 8 aa, synthetic construct
GSSEAAAK

SEQ ID NO: 13801 - protein, 9 aa, synthetic construct
GGSPAPGGG

SEQ ID NO: 13802 - protein, 8 aa, synthetic construct
EAAAKGGG

SEQ ID NO: 13803 - protein, 11 aa, synthetic construct
GSSEAAAKGGS

SEQ ID NO: 13804 - protein, 9 aa, synthetic construct
GSSGGSPAP

SEQ ID NO: 13805 - protein, 6 aa, synthetic construct
GGGGGS

SEQ ID NO: 13806 - protein, 6 aa, synthetic construct
GSSGGG

SEQ ID NO: 13807 - protein, 6 aa, synthetic construct
GSSGSS

SEQ ID NO: 13808 - protein, 11 aa, synthetic construct
GGSEAAAKPAP

SEQ ID NO: 13809 - protein, 11 aa, synthetic construct
EAAAKGGGGSS

SEQ ID NO: 13810 - protein, 11 aa, synthetic construct
EAAAKPAPGGS

SEQ ID NO: 13811 - protein, 15 aa, synthetic construct
GSSGSSGSSGSSGSS

SEQ ID NO: 13812 - protein, 15 aa, synthetic construct
GGGGSEAAAKGGGGS

SEQ ID NO: 13813 - protein, 6 aa, synthetic construct
GGSGSS

SEQ ID NO: 13814 - skipped

SEQ ID NO: 13815 - protein, 5 aa, synthetic construct
PAPAP

SEQ ID NO: 13816 - protein, 8 aa, synthetic construct
EAAAKPAP

SEQ ID NO: 13817 - protein, 25 aa, synthetic construct
EAAAKEAAAKEAAAKEAAAKEAAAK

SEQ ID NO: 13818 - protein, 7 aa, synthetic construct
GGGGGGG

SEQ ID NO: 13819 - protein, 5 aa, synthetic construct
GGGGS

SEQ ID NO: 13820 - protein, 6 aa, synthetic construct
GSSGGG

SEQ ID NO: 13821 - protein, 11 aa, synthetic construct
PAPAPAPAPAP

SEQ ID NO: 13822 - protein, 15 aa, synthetic construct
EAAAKEAAAKEAAAK

SEQ ID NO: 13823 - protein, 6 aa, synthetic construct
GSSGGS

SEQ ID NO: 13824 - protein, 11 aa, synthetic construct
EAAAKPAPGGG

SEQ ID NO: 13825 - protein, 9 aa, synthetic construct
GSSPAPGGS

SEQ ID NO: 13826 - protein, 9 aa, synthetic construct
PAPGSSGGG

SEQ ID NO: 13827 - protein, 6 aa, synthetic construct
GSSGGG

SEQ ID NO: 13828 - protein, 9 aa, synthetic construct
PAPGGSGSS

SEQ ID NO: 13829 - protein, 6 aa, synthetic construct
PAPGSS

SEQ ID NO: 13830 - protein, 9 aa, synthetic construct
GGGGGSGSS

SEQ ID NO: 13831 - protein, 11 aa, synthetic construct
EAAAKGGGGSS

SEQ ID NO: 13832 - protein, 7 aa, synthetic construct
GGGGGGG

SEQ ID NO: 13833 - protein, 11 aa, synthetic construct
PAPEAAAKGSS

SEQ ID NO: 13834 - protein, 11 aa, synthetic construct
GGSGGGEAAAK

SEQ ID NO: 13835 - protein, 11 aa, synthetic construct
EAAAKGGGGGS

SEQ ID NO: 13836 - protein, 6 aa, synthetic construct
PAPGGS

SEQ ID NO: 13837 - protein, 4 aa, synthetic construct
GGGG

SEQ ID NO: 13838 - protein, 11 aa, synthetic construct
EAAAKGGSGSS

SEQ ID NO: 13839 - protein, 9 aa, synthetic construct
GGGGSSGGS

SEQ ID NO: 13840 - protein, 8 aa, synthetic construct
GGGGGGGG

SEQ ID NO: 13841 - protein, 9 aa, synthetic construct
GGSGSSGGG

SEQ ID NO: 13842 - protein, 11 aa, synthetic construct
GSSEAAAKGGS

SEQ ID NO: 13843 - protein, 11 aa, synthetic construct
EAAAKPAPGSS

SEQ ID NO: 13844 - protein, 9 aa, synthetic construct
GGSPAPGSS

SEQ ID NO: 13845 - protein, 9 aa, synthetic construct
PAPGSSGGG

SEQ ID NO: 13846 - protein, 11 aa, synthetic construct
EAAAKPAPGSS

SEQ ID NO: 13847 - protein, 11 aa, synthetic construct
GGSPAPEAAAK

SEQ ID NO: 13848 - protein, 6 aa, synthetic construct
GSSPAP

SEQ ID NO: 13849 - skipped

SEQ ID NO: 13850 - protein, 11 aa, synthetic construct
EAAAKPAPGGS

SEQ ID NO: 13851 - protein, 9 aa, synthetic construct
GGSGSSPAP

SEQ ID NO: 13852 - protein, 9 aa, synthetic construct
PAPGSSGGS

SEQ ID NO: 13853 - protein, 12 aa, synthetic construct
GSAGSAAGSGEF

SEQ ID NO: 13854 - protein, 11 aa, synthetic construct
GSSGGSEAAAK

SEQ ID NO: 13855 - protein, 6 aa, synthetic construct
GSSGGS

SEQ ID NO: 13856 - protein, 15 aa, synthetic construct
EAAAKGGGGSEAAAK

SEQ ID NO: 13857 - protein, 6 aa, synthetic construct
GSSGGS

SEQ ID NO: 13858 - protein, 11 aa, synthetic construct
GGSPAPEAAAK

SEQ ID NO: 13859 - protein, 11 aa, synthetic construct
GGSEAAAKGSS

SEQ ID NO: 13860 - protein, 11 aa, synthetic construct
GSSPAPEAAAK

SEQ ID NO: 13861 - protein, 9 aa, synthetic construct
GGSGSSGGG

SEQ ID NO: 13862 - protein, 4 aa, synthetic construct
GGGG

SEQ ID NO: 13863 - protein, 11 aa, synthetic construct
GGSEAAAKPAP

SEQ ID NO: 13864 - protein, 9 aa, synthetic construct
GSSGGSPAP

SEQ ID NO: 13865 - protein, 11 aa, synthetic construct
GSSGGSEAAAK

SEQ ID NO: 13866 - protein, 11 aa, synthetic construct
PAPEAAAKGGS

SEQ ID NO: 13867 - protein, 6 aa, synthetic construct
GGSPAP

SEQ ID NO: 13868 - protein, 8 aa, synthetic construct
GGSEAAAK

SEQ ID NO: 13869 - protein, 15 aa, synthetic construct
EAAAKGGGGSEAAAK

SEQ ID NO: 13870 - protein, 33 aa, synthetic construct; identical to SEQ ID NO: 5006

SEQ ID NO: 13871 - protein, 8 aa, synthetic construct
GSSEAAAK

SEQ ID NO: 13872 - skipped

SEQ ID NO: 13873 - protein, 11 aa, synthetic construct
GGSEAAAKGSS

SEQ ID NO: 13874 - protein, 11 aa, synthetic construct
GGSEAAAKGSS

SEQ ID NO: 13875 - protein, 11 aa, synthetic construct
GGSPAPEAAAK

SEQ ID NO: 13876 - protein, 11 aa, synthetic construct
GGSGGGEAAAK

SEQ ID NO: 13877 - protein, 11 aa, synthetic construct
GGSEAAAKPAP

SEQ ID NO: 13878 - protein, 11 aa, synthetic construct
EAAAKGGSGSS

SEQ ID NO: 13879 - protein, 11 aa, synthetic construct
GGGEAAAKGGS

SEQ ID NO: 13880 - protein, 15 aa, synthetic construct
EAAAKGGGGSEAAAK

SEQ ID NO: 13881 - protein, 6 aa, synthetic construct
GGSPAP

SEQ ID NO: 13882 - protein, 9 aa, synthetic construct
GGGGSSGGS

SEQ ID NO: 13883-13884 - skipped (2 entries)

SEQ ID NO: 13885 - protein, 10 aa, synthetic construct
GGGGSGGGGS

SEQ ID NO: 13886 - protein, 11 aa, synthetic construct
GGGEAAAKGGS

SEQ ID NO: 13887 - protein, 18 aa, synthetic construct
GSSGSSGSSGSSGSSGSS

SEQ ID NO: 13888 - protein, 6 aa, synthetic construct
PAPGSS

SEQ ID NO: 13889 - protein, 9 aa, synthetic construct
GGSGGSGGS

SEQ ID NO: 13890 - protein, 9 aa, synthetic construct
PAPGGSGGG

SEQ ID NO: 13891 - protein, 15 aa, synthetic construct
GGGGSGGGGSGGGGS

SEQ ID NO: 13892 - protein, 9 aa, synthetic construct
GGSGSSGGG

SEQ ID NO: 13893 - protein, 9 aa, synthetic construct
GGSGGSGGS

SEQ ID NO: 13894 - protein, 11 aa, synthetic construct
GGGEAAAKGGS

SEQ ID NO: 13895 - protein, 16 aa, synthetic construct
SGSETPGTSESATPES

SEQ ID NO: 13896 - protein, 11 aa, synthetic construct
EAAAKGGGGGS

SEQ ID NO: 13897 - protein, 11 aa, synthetic construct
EAAAKGSSPAP

SEQ ID NO: 13898 - protein, 4 aa, synthetic construct
GGGG

SEQ ID NO: 13899 - protein, 25 aa, synthetic construct
GGGGSGGGGSGGGGSGGGGSGGGGS

SEQ ID NO: 13900 - protein, 9 aa, synthetic construct
GSSGGSGGG

SEQ ID NO: 13901 - protein, 6 aa, synthetic construct
GGSGSS

SEQ ID NO: 13902 - protein, 8 aa, synthetic construct
EAAAKGGS

SEQ ID NO: 13903 - protein, 11 aa, synthetic construct
GSSEAAAKGGS

SEQ ID NO: 13904 - protein, 11 aa, synthetic construct
EAAAKPAPGGG

SEQ ID NO: 13905 - protein, 9 aa, synthetic construct
PAPGSSGGG

SEQ ID NO: 13906 - protein, 11 aa, synthetic construct
GGGGSSEAAAK

SEQ ID NO: 13907 - protein, 11 aa, synthetic construct
GSSEAAAKPAP

SEQ ID NO: 13908 - protein, 11 aa, synthetic construct
PAPGGGEAAAK

SEQ ID NO: 13909 - protein, 11 aa, synthetic construct
GGSGGGEAAAK

SEQ ID NO: 13910 - protein, 30 aa, synthetic construct; identical to SEQ ID NO: 5112

SEQ ID NO: 13911 - protein, 11 aa, synthetic construct
EAAAKGGGGGS

SEQ ID NO: 13912 - protein, 9 aa, synthetic construct
GGSPAPGGG

SEQ ID NO: 13913 - protein, 9 aa, synthetic construct
GSSGSSGSS

SEQ ID NO: 13914 - protein, 5 aa, synthetic construct
EAAAK

SEQ ID NO: 13915 - protein, 9 aa, synthetic construct
GGGGSSGGS

SEQ ID NO: 13916 - protein, 9 aa, synthetic construct
GGSGSSPAP

SEQ ID NO: 13917 - protein, 20 aa, synthetic construct
EAAAKEAAAKEAAAKEAAAK

SEQ ID NO: 13918 - protein, 9 aa, synthetic construct
GGGPAPGSS

SEQ ID NO: 13919 - protein, 9 aa, synthetic construct
GSSPAPGGS

SEQ ID NO: 13920 - protein, 5 aa, synthetic construct
PAPAP

SEQ ID NO: 13921 - protein, 9 aa, synthetic construct
PAPAPAPAP

SEQ ID NO: 13922 - protein, 11 aa, synthetic construct
GGGGGSEAAAK

SEQ ID NO: 13923 - protein, 9 aa, synthetic construct
GGGGGSGSS

SEQ ID NO: 13924 - protein, 11 aa, synthetic construct
GGGEAAAKGSS

SEQ ID NO: 13925 - protein, 9 aa, synthetic construct
GGGGGSPAP

SEQ ID NO: 13926 - protein, 11 aa, synthetic construct
GGGGGSEAAAK

SEQ ID NO: 13927 - skipped

SEQ ID NO: 13928 - protein, 7 aa, synthetic construct
GGGGGGG

SEQ ID NO: 13929 - protein, 16 aa, synthetic construct
SGSETPGTSESATPES

SEQ ID NO: 13930 - protein, 11 aa, synthetic construct
EAAAKGGSGGG

SEQ ID NO: 13931 - protein, 5 aa, synthetic construct
GGGGS

SEQ ID NO: 13932 - protein, 11 aa, synthetic construct
EAAAKGSSGGG

SEQ ID NO: 13933 - protein, 11 aa, synthetic construct
EAAAKPAPGGS

SEQ ID NO: 13934 - protein, 33 aa, synthetic construct; identical to SEQ ID NO: 5006

SEQ ID NO: 13935 - protein, 9 aa, synthetic construct
GGSPAPGGG

SEQ ID NO: 13936 - protein, 12 aa, synthetic construct
GSAGSAAGSGEF

SEQ ID NO: 13937 - protein, 9 aa, synthetic construct
GGGGSSGGS

SEQ ID NO: 13938 - protein, 7 aa, synthetic construct
GGGGGGG

SEQ ID NO: 13939 - protein, 8 aa, synthetic construct
GSSEAAAK

SEQ ID NO: 13940 - protein, 6 aa, synthetic construct
PAPGSS

SEQ ID NO: 13941 - protein, 6 aa, synthetic construct
GSSGGG

SEQ ID NO: 13942 - protein, 6 aa, synthetic construct
PAPGGG

SEQ ID NO: 13943 - protein, 9 aa, synthetic construct
GGGGGSPAP

SEQ ID NO: 13944 - protein, 8 aa, synthetic construct
GGSEAAAK

SEQ ID NO: 13945 - protein, 6 aa, synthetic construct
GSSGGG

SEQ ID NO: 13946 - protein, 12 aa, synthetic construct
GGSGGSGGSGGS

SEQ ID NO: 13947 - protein, 5 aa, synthetic construct
PAPAP

SEQ ID NO: 13948 - protein, 8 aa, synthetic construct
GGSEAAAK

SEQ ID NO: 13949 - protein, 5 aa, synthetic construct
GGGGS

SEQ ID NO: 13950 - protein, 4 aa, synthetic construct
GGGG

SEQ ID NO: 13951 - protein, 11 aa, synthetic construct
EAAAKGGGGSS

SEQ ID NO: 13952 - protein, 15 aa, synthetic construct
EAAAKEAAAKEAAAK

SEQ ID NO: 13953 - protein, 11 aa, synthetic construct
PAPGGGEAAAK

SEQ ID NO: 13954 - protein, 11 aa, synthetic construct
EAAAKGGSPAP

SEQ ID NO: 13955 - protein, 11 aa, synthetic construct
GGSGSSEAAAK

SEQ ID NO: 13956 - protein, 11 aa, synthetic construct
GGSPAPEAAAK

SEQ ID NO: 13957 - protein, 7 aa, synthetic construct
GGGGGGG

SEQ ID NO: 13958 - protein, 30 aa, synthetic construct; identical to SEQ ID NO: 5130

SEQ ID NO: 13959 - protein, 11 aa, synthetic construct
EAAAKGSSGGS

SEQ ID NO: 13960 - protein, 11 aa, synthetic construct
GSSEAAAKPAP

SEQ ID NO: 13961 - protein, 6 aa, synthetic construct
GGGGSS

SEQ ID NO: 13962 - protein, 11 aa, synthetic construct
EAAAKGGSGGG

SEQ ID NO: 13963 - protein, 6 aa, synthetic construct
GGSGGS

SEQ ID NO: 13964 - protein, 9 aa, synthetic construct
GGGGGSPAP

SEQ ID NO: 13965 - protein, 15 aa, synthetic construct
EAAAKEAAAKEAAAK

SEQ ID NO: 13966 - protein, 11 aa, synthetic construct
PAPEAAAKGGS

SEQ ID NO: 13967 - protein, 11 aa, synthetic construct
GSSGGSEAAAK

SEQ ID NO: 13968 - protein, 11 aa, synthetic construct
EAAAKGGSGGG

SEQ ID NO: 13969 - protein, 9 aa, synthetic construct
GGSGGGPAP

SEQ ID NO: 13970 - skipped

SEQ ID NO: 13971 - protein, 11 aa, synthetic construct
GGSEAAAKPAP

SEQ ID NO: 13972 - protein, 8 aa, synthetic construct
EAAAKGGG

SEQ ID NO: 13973 - protein, 12 aa, synthetic construct
GSSGSSGSSGSS

SEQ ID NO: 13974 - protein, 9 aa, synthetic construct
GGSGSSPAP

SEQ ID NO: 13975 - protein, 8 aa, synthetic construct
GGGEAAAK

SEQ ID NO: 13976 - protein, 9 aa, synthetic construct
GSSPAPGGS

SEQ ID NO: 13977 - protein, 11 aa, synthetic construct
GSSEAAAKGGG

SEQ ID NO: 13978 - protein, 11 aa, synthetic construct
EAAAKPAPGGS

SEQ ID NO: 13979 - protein, 11 aa, synthetic construct
GGSGGGEAAAK

SEQ ID NO: 13980 - protein, 6 aa, synthetic construct
GGSGSS

SEQ ID NO: 13981 - protein, 11 aa, synthetic construct
GGSGGGEAAAK

SEQ ID NO: 13982 - protein, 18 aa, synthetic construct
GGSGGSGGSGGSGGSGGS

SEQ ID NO: 13983 - protein, 11 aa, synthetic construct
PAPEAAAKGSS

SEQ ID NO: 13984 - protein, 11 aa, synthetic construct
EAAAKGSSGGS

SEQ ID NO: 13985 - protein, 11 aa, synthetic construct
GGSGSSEAAAK

SEQ ID NO: 13986 - protein, 11 aa, synthetic construct
GGSGSSEAAAK

SEQ ID NO: 13987 - protein, 9 aa, synthetic construct
GSSGGSGGG

SEQ ID NO: 13988 - protein, 11 aa, synthetic construct
EAAAKGGSGGG

SEQ ID NO: 13989 - protein, 6 aa, synthetic construct
GGSGGS

SEQ ID NO: 13990 - protein, 12 aa, synthetic construct
GSAGSAAGSGEF

SEQ ID NO: 13991 - protein, 6 aa, synthetic construct
GGSGSS

SEQ ID NO: 13992 - protein, 4 aa, synthetic construct
GGGG

SEQ ID NO: 13993 - protein, 20 aa, synthetic construct
GGGGSGGGGSGGGGSGGGGS

SEQ ID NO: 13994 - protein, 16 aa, synthetic construct
SGSETPGTSESATPES

SEQ ID NO: 13995 - protein, 20 aa, synthetic construct
EAAAKEAAAKEAAAKEAAAK

SEQ ID NO: 13996 - protein, 11 aa, synthetic construct
GGGEAAAKGGS

SEQ ID NO: 13997 - protein, 11 aa, synthetic construct
GSSGGSEAAAK

SEQ ID NO: 13998 - protein, 11 aa, synthetic construct
EAAAKGGGGSS

SEQ ID NO: 13999 - protein, 11 aa, synthetic construct
PAPGGSEAAAK

SEQ ID NO: 14000 - protein, 5 aa, synthetic construct
EAAAK

SEQ ID NO: 14001 - protein, 18 aa, synthetic construct
GSSGSSGSSGSSGSSGSS

SEQ ID NO: 14002 - protein, 4 aa, synthetic construct
GGGG

SEQ ID NO: 14003 - protein, 6 aa, synthetic construct
GSSGSS

SEQ ID NO: 14004 - protein, 9 aa, synthetic construct
GSSGGSPAP

SEQ ID NO: 14005 - protein, 9 aa, synthetic construct
GGSGGSGGS

SEQ ID NO: 14006 - protein, 11 aa, synthetic construct
EAAAKGGGPAP

SEQ ID NO: 14007 - protein, 10 aa, synthetic construct
GGGGSGGGGS

SEQ ID NO: 14008 - protein, 11 aa, synthetic construct
GGSEAAAKGSS

SEQ ID NO: 14009 - protein, 30 aa, synthetic construct; identical to SEQ ID NO: 5130

SEQ ID NO: 14010 - protein, 11 aa, synthetic construct
GGSGSSEAAAK

SEQ ID NO: 14011 - protein, 20 aa, synthetic construct
EAAAKEAAAKEAAAKEAAAK

SEQ ID NO: 14012 - protein, 11 aa, synthetic construct
GSSEAAAKGGS

SEQ ID NO: 14013 - protein, 6 aa, synthetic construct
GGSGSS

SEQ ID NO: 14014 - protein, 11 aa, synthetic construct
GGSGSSEAAAK

SEQ ID NO: 14015 - protein, 9 aa, synthetic construct
GSSGSSGSS

SEQ ID NO: 14016 - protein, 11 aa, synthetic construct
EAAAKGSSPAP

SEQ ID NO: 14017 - protein, 8 aa, synthetic construct
EAAAKPAP

SEQ ID NO: 14018 - protein, 11 aa, synthetic construct
GGSGSSEAAAK

SEQ ID NO: 14019 - protein, 30 aa, synthetic construct; identical to SEQ ID NO: 5112

SEQ ID NO: 14020 - protein, 15 aa, synthetic construct
GGGGSGGGGSGGGGS

SEQ ID NO: 14021 - protein, 7 aa, synthetic construct
GGGGGGG

SEQ ID NO: 14022 - protein, 8 aa, synthetic construct
EAAAKGSS

SEQ ID NO: 14023 - protein, 11 aa, synthetic construct
EAAAKGGGPAP

SEQ ID NO: 14024 - protein, 6 aa, synthetic construct
GSSGSS

SEQ ID NO: 14025 - protein, 11 aa, synthetic construct
EAAAKGGGGGS

SEQ ID NO: 14026 - protein, 11 aa, synthetic construct
GGSGGGEAAAK

SEQ ID NO: 14027 - protein, 6 aa, synthetic construct
PAPGSS

SEQ ID NO: 14028 - protein, 6 aa, synthetic construct
PAPGSS

SEQ ID NO: 14029 - protein, 9 aa, synthetic construct
GGSPAPGSS

SEQ ID NO: 14030 - protein, 11 aa, synthetic construct
GGGGSSEAAAK

SEQ ID NO: 14031 - protein, 9 aa, synthetic construct
GSSGGGGGS

SEQ ID NO: 14032 - protein, 11 aa, synthetic construct
EAAAKGSSPAP

SEQ ID NO: 14033 - protein, 9 aa, synthetic construct
GSSPAPGGS

SEQ ID NO: 14034 - protein, 6 aa, synthetic construct
GGGGGG

SEQ ID NO: 14035 - protein, 11 aa, synthetic construct
EAAAKGGGGSS

SEQ ID NO: 14036 - protein, 11 aa, synthetic construct
PAPGGSEAAAK

SEQ ID NO: 14037 - protein, 33 aa, synthetic construct; identical to SEQ ID NO: 5006

SEQ ID NO: 14038 - protein, 12 aa, synthetic construct
GSSGSSGSSGSS

SEQ ID NO: 14039 - protein, 11 aa, synthetic construct
EAAAKGSSGGG

SEQ ID NO: 14040 - protein, 11 aa, synthetic construct
GGSEAAAKPAP

SEQ ID NO: 14041 - protein, 15 aa, synthetic construct
GSSGSSGSSGSSGSS

SEQ ID NO: 14042 - protein, 11 aa, synthetic construct
GGGEAAAKPAP

SEQ ID NO: 14043 - protein, 9 aa, synthetic construct
PAPGSSGGG

SEQ ID NO: 14044 - protein, 6 aa, synthetic construct
GSSGSS

SEQ ID NO: 14045 - protein, 8 aa, synthetic construct
PAPEAAAK

SEQ ID NO: 14046 - protein, 9 aa, synthetic construct
GGGPAPGSS

SEQ ID NO: 14047 - protein, 9 aa, synthetic construct
GSSGGSPAP

SEQ ID NO: 14048 - protein, 6 aa, synthetic construct
GGGGSS

SEQ ID NO: 14049 - protein, 11 aa, synthetic construct
PAPEAAAKGSS

SEQ ID NO: 14050 - protein, 9 aa, synthetic construct
GGSGGGPAP

SEQ ID NO: 14051 - protein, 6 aa, synthetic construct
PAPGGS

SEQ ID NO: 14052 - protein, 11 aa, synthetic construct
EAAAKGGGGGS

SEQ ID NO: 14053 - protein, 9 aa, synthetic construct
GSSGGSPAP

SEQ ID NO: 14054 - protein, 9 aa, synthetic construct
GSSGGGGGS

SEQ ID NO: 14055 - protein, 11 aa, synthetic construct
GGGEAAAKGGS

SEQ ID NO: 14056 - protein, 11 aa, synthetic construct
GGGEAAAKGSS

SEQ ID NO: 14057 - protein, 11 aa, synthetic construct
PAPEAAAKGSS

SEQ ID NO: 14058 - protein, 15 aa, synthetic construct
GSSGSSGSSGSSGSS

SEQ ID NO: 14059 - protein, 9 aa, synthetic construct
GGSPAPGSS

SEQ ID NO: 14060 - protein, 11 aa, synthetic construct
EAAAKGSSPAP

SEQ ID NO: 14061 - protein, 18 aa, synthetic construct
GGSGGSGGSGGSGGSGGS

SEQ ID NO: 14062 - protein, 11 aa, synthetic construct
GGGGSSEAAAK

SEQ ID NO: 14063 - protein, 9 aa, synthetic construct
GGGGSSPAP

SEQ ID NO: 14064 - protein, 9 aa, synthetic construct
GSSGGSPAP

SEQ ID NO: 14065 - protein, 9 aa, synthetic construct
GGGPAPGSS

SEQ ID NO: 14066 - protein, 9 aa, synthetic construct
PAPGSSGGS

SEQ ID NO: 14067 - protein, 9 aa, synthetic construct
GGGGGSPAP

SEQ ID NO: 14068 - protein, 16 aa, synthetic construct
SGSETPGTSESATPES

SEQ ID NO: 14069 - protein, 15 aa, synthetic construct
GSSGSSGSSGSSGSS

SEQ ID NO: 14070 - protein, 9 aa, synthetic construct
GSSPAPGGG

SEQ ID NO: 14071 - protein, 13 aa, synthetic construct
PAPAPAPAPAPAP

SEQ ID NO: 14072 - protein, 9 aa, synthetic construct
GGGPAPGGS

SEQ ID NO: 14073 - protein, 11 aa, synthetic construct
PAPGGSEAAAK

SEQ ID NO: 14074 - protein, 11 aa, synthetic construct
GGGGSSEAAAK

SEQ ID NO: 14075 - protein, 9 aa, synthetic construct
GGSPAPGGG

SEQ ID NO: 14076 - protein, 11 aa, synthetic construct
GSSPAPEAAAK

SEQ ID NO: 14077 - protein, 8 aa, synthetic construct
GGGEAAAK

SEQ ID NO: 14078 - protein, 11 aa, synthetic construct
PAPEAAAKGGG

SEQ ID NO: 14079 - protein, 9 aa, synthetic construct
GGSPAPGGG

SEQ ID NO: 14080 - protein, 9 aa, synthetic construct
GGSGGGGSS

SEQ ID NO: 14081 - protein, 11 aa, synthetic construct
GSSPAPEAAAK

SEQ ID NO: 14082 - protein, 9 aa, synthetic construct
GGSPAPGGG

SEQ ID NO: 14083 - protein, 9 aa, synthetic construct
PAPGGSGSS

SEQ ID NO: 14084 - protein, 6 aa, synthetic construct
GSSPAP

SEQ ID NO: 14085 - protein, 16 aa, synthetic construct
SGSETPGTSESATPES

SEQ ID NO: 14086 - protein, 9 aa, synthetic construct
GSSGSSGSS

SEQ ID NO: 14087 - protein, 9 aa, synthetic construct
PAPGSSGGS

SEQ ID NO: 14088 - protein, 6 aa, synthetic construct
PAPGGS

SEQ ID NO: 14089 - protein, 11 aa, synthetic construct
PAPEAAAKGGG

SEQ ID NO: 14090 - protein, 9 aa, synthetic construct
GGSGGSGGS

SEQ ID NO: 14091 - protein, 6 aa, synthetic construct
PAPGGS

SEQ ID NO: 14092 - protein, 9 aa, synthetic construct
GSSGGSPAP

SEQ ID NO: 14093 - protein, 9 aa, synthetic construct
GSSGGGGGS

SEQ ID NO: 14094 - protein, 9 aa, synthetic construct
GGGGGSPAP

SEQ ID NO: 14095 - protein, 11 aa, synthetic construct
EAAAKPAPGSS

SEQ ID NO: 14096 - protein, 11 aa, synthetic construct
EAAAKGGSPAP

SEQ ID NO: 14097 - protein, 11 aa, synthetic construct
GGGPAPEAAAK

SEQ ID NO: 14098 - protein, 11 aa, synthetic construct
GGSEAAAKGSS

SEQ ID NO: 14099 - protein, 11 aa, synthetic construct
PAPEAAAKGSS

SEQ ID NO: 14100 - protein, 11 aa, synthetic construct
PAPEAAAKGGS

SEQ ID NO: 14101 - protein, 6 aa, synthetic construct
GSSGGG

SEQ ID NO: 14102 - protein, 11 aa, synthetic construct
EAAAKGGGGSS

SEQ ID NO: 14103 - protein, 11 aa, synthetic construct
EAAAKGGSPAP

SEQ ID NO: 14104 - protein, 9 aa, synthetic construct
GGGGSSGGS

SEQ ID NO: 14105 - protein, 11 aa, synthetic construct
PAPEAAAKGSS

SEQ ID NO: 14106 - protein, 11 aa, synthetic construct
EAAAKGGGGGS

SEQ ID NO: 14107 - protein, 9 aa, synthetic construct
GSSGGGGGS

SEQ ID NO: 14108 - protein, 9 aa, synthetic construct
PAPAPAPAP

SEQ ID NO: 14109 - protein, 12 aa, synthetic construct
GGSGGSGGSGGS

SEQ ID NO: 14110 - protein, 9 aa, synthetic construct
PAPAPAPAP

SEQ ID NO: 14111 - protein, 11 aa, synthetic construct
GSSEAAAKPAP

SEQ ID NO: 14112 - protein, 11 aa, synthetic construct
GGSGGGEAAAK

SEQ ID NO: 14113 - protein, 9 aa, synthetic construct
GSSGGSGGG

SEQ ID NO: 14114 - protein, 9 aa, synthetic construct
GGGGGSPAP

SEQ ID NO: 14115 - protein, 11 aa, synthetic construct
GGGEAAAKGSS

SEQ ID NO: 14116 - protein, 9 aa, synthetic construct
GGGGSSPAP

SEQ ID NO: 14117 - protein, 6 aa, synthetic construct
GGSGGG

SEQ ID NO: 14118 - protein, 6 aa, synthetic construct
GGGGSS

SEQ ID NO: 14119 - protein, 11 aa, synthetic construct
EAAAKGSSGGS

SEQ ID NO: 14120 - protein, 9 aa, synthetic construct
GSSGGGGGS

SEQ ID NO: 14121 - protein, 11 aa, synthetic construct
EAAAKGSSGGS

SEQ ID NO: 14122 - protein, 10 aa, synthetic construct
EAAAKEAAAK

SEQ ID NO: 14123 - protein, 11 aa, synthetic construct
GSSGGGEAAAK

SEQ ID NO: 14124 - protein, 9 aa, synthetic construct
GSSPAPGGG

SEQ ID NO: 14125 - protein, 15 aa, synthetic construct
GGGGSGGGGSGGGGS

SEQ ID NO: 14126 - protein, 20 aa, synthetic construct
EAAAKEAAAKEAAAKEAAAK

SEQ ID NO: 14127 - protein, 11 aa, synthetic construct
EAAAKGGSGSS

SEQ ID NO: 14128 - protein, 8 aa, synthetic construct
PAPEAAAK

SEQ ID NO: 14129 - protein, 6 aa, synthetic construct
GSSGGG

SEQ ID NO: 14130 - protein, 11 aa, synthetic construct
GGSGGGEAAAK

SEQ ID NO: 14131 - protein, 5 aa, synthetic construct
EAAAK

SEQ ID NO: 14132 - protein, 9 aa, synthetic construct
GGGGSSPAP

SEQ ID NO: 14133 - skipped

SEQ ID NO: 14134 - protein, 11 aa, synthetic construct
PAPEAAAKGSS

SEQ ID NO: 14135 - protein, 9 aa, synthetic construct
GGGGGSPAP

SEQ ID NO: 14136 - protein, 9 aa, synthetic construct
GSSGSSGSS

SEQ ID NO: 14137 - protein, 20 aa, synthetic construct
GGGGSGGGGSGGGGSGGGGS

SEQ ID NO: 14138 - protein, 11 aa, synthetic construct
GGGGSSEAAAK

SEQ ID NO: 14139 - protein, 20 aa, synthetic construct
GGGGSGGGGSGGGGSGGGGS

SEQ ID NO: 14140 - protein, 11 aa, synthetic construct
PAPGSSEAAAK

SEQ ID NO: 14141 - protein, 9 aa, synthetic construct
GGGGGSGSS

SEQ ID NO: 14142 - protein, 11 aa, synthetic construct
GGSEAAAKGGG

SEQ ID NO: 14143 - protein, 9 aa, synthetic construct
PAPGSSGGG

SEQ ID NO: 14144 - skipped

SEQ ID NO: 14145 - protein, 11 aa, synthetic construct
EAAAKGGSGSS

SEQ ID NO: 14146 - protein, 8 aa, synthetic construct
GGGEAAAK

SEQ ID NO: 14147 - protein, 11 aa, synthetic construct
GGSEAAAKPAP

SEQ ID NO: 14148 - protein, 16 aa, synthetic construct
SGSETPGTSESATPES

SEQ ID NO: 14149 - protein, 11 aa, synthetic construct
EAAAKPAPGGS

SEQ ID NO: 14150 - protein, 11 aa, synthetic construct
EAAAKGGGGGS

SEQ ID NO: 14151 - protein, 5 aa, synthetic construct
GGGGS

SEQ ID NO: 14152 - protein, 11 aa, synthetic construct
GGSEAAAKGSS

SEQ ID NO: 14153 - protein, 11 aa, synthetic construct
GGSEAAAKGGG

SEQ ID NO: 14154 - protein, 18 aa, synthetic construct
GGSGGSGGSGGSGGSGGS

SEQ ID NO: 14155 - protein, 11 aa, synthetic construct
GGSEAAAKGSS

SEQ ID NO: 14156 - protein, 11 aa, synthetic construct
GGGEAAAKPAP

SEQ ID NO: 14157 - protein, 8 aa, synthetic construct
GGSEAAAK

SEQ ID NO: 14158 - protein, 9 aa, synthetic construct
GGSPAPGSS

SEQ ID NO: 14159 - protein, 11 aa, synthetic construct
GSSPAPEAAAK

SEQ ID NO: 14160 - protein, 6 aa, synthetic construct
GGSGSS

SEQ ID NO: 14161 - protein, 9 aa, synthetic construct
PAPGGGGGS

SEQ ID NO: 14162 - protein, 11 aa, synthetic construct
PAPEAAAKGSS

SEQ ID NO: 14163 - protein, 11 aa, synthetic construct
GGSGGGEAAAK

SEQ ID NO: 14164 - protein, 6 aa, synthetic construct
PAPGGG

SEQ ID NO: 14165 - protein, 8 aa, synthetic construct
EAAAKGGG

SEQ ID NO: 14166 - protein, 12 aa, synthetic construct
GSSGSSGSSGSS

SEQ ID NO: 14167 - protein, 11 aa, synthetic construct
EAAAKGGSGGG

SEQ ID NO: 14168 - protein, 9 aa, synthetic construct
GSSPAPGGS

SEQ ID NO: 14169 - protein, 9 aa, synthetic construct
GSSPAPGGS

SEQ ID NO: 14170 - protein, 6 aa, synthetic construct
GGGPAP

SEQ ID NO: 14171 - protein, 6 aa, synthetic construct
GGGPAP

SEQ ID NO: 14172 - protein, 9 aa, synthetic construct
GGSPAPGSS

SEQ ID NO: 14173 - protein, 5 aa, synthetic construct
PAPAP

SEQ ID NO: 14174 - protein, 7 aa, synthetic construct
GGGGGGG

SEQ ID NO: 14175 - protein, 5 aa, synthetic construct
GGGGG

SEQ ID NO: 14176 - protein, 12 aa, synthetic construct
GSAGSAAGSGEF

SEQ ID NO: 14177 - protein, 5 aa, synthetic construct
PAPAP

SEQ ID NO: 14178 - protein, 11 aa, synthetic construct
GGSEAAAKGGG

SEQ ID NO: 14179 - protein, 5 aa, synthetic construct
PAPAP

SEQ ID NO: 14180 - protein, 15 aa, synthetic construct
GGGGSGGGGSGGGGS

SEQ ID NO: 14181 - protein, 6 aa, synthetic construct
PAPGGS

SEQ ID NO: 14182 - protein, 11 aa, synthetic construct
GGGEAAAKPAP

SEQ ID NO: 14183 - protein, 6 aa, synthetic construct
GGGGGS

SEQ ID NO: 14184 - protein, 11 aa, synthetic construct
GSSEAAAKGGG

SEQ ID NO: 14185 - protein, 11 aa, synthetic construct
EAAAKGGGGSS

SEQ ID NO: 14186 - protein, 6 aa, synthetic construct
GSSGGS

SEQ ID NO: 14187 - protein, 6 aa, synthetic construct
GSSGGG

SEQ ID NO: 14188 - protein, 7 aa, synthetic construct
PAPAPAP

SEQ ID NO: 14189 - protein, 4 aa, synthetic construct
GGGG

SEQ ID NO: 14190 - protein, 11 aa, synthetic construct
EAAAKPAPGGS

SEQ ID NO: 14191 - protein, 10 aa, synthetic construct
GGGGSGGGGS

SEQ ID NO: 14192 - protein, 8 aa, synthetic construct
EAAAKGGG

SEQ ID NO: 14193 - protein, 9 aa, synthetic construct
GGGGSSPAP

SEQ ID NO: 14194 - protein, 11 aa, synthetic construct
GSSEAAAKGGG

SEQ ID NO: 14195 - protein, 5 aa, synthetic construct
GGGGG

SEQ ID NO: 14196 - protein, 11 aa, synthetic construct
GGGEAAAKGSS

SEQ ID NO: 14197 - protein, 9 aa, synthetic construct
GSSGSSGSS

SEQ ID NO: 14198 - protein, 9 aa, synthetic construct
GSSGGSPAP

SEQ ID NO: 14199 - protein, 8 aa, synthetic construct
EAAAKGGS

SEQ ID NO: 14200 - protein, 11 aa, synthetic construct
GGSPAPEAAAK

SEQ ID NO: 14201 - protein, 8 aa, synthetic construct
GGSEAAAK

SEQ ID NO: 14202 - protein, 6 aa, synthetic construct
GSSGGS

SEQ ID NO: 14203 - protein, 11 aa, synthetic construct
GGGPAPEAAAK

SEQ ID NO: 14204 - protein, 6 aa, synthetic construct
PAPGSS

SEQ ID NO: 14205 - protein, 11 aa, synthetic construct
GGSEAAAKGSS

SEQ ID NO: 14206 - protein, 25 aa, synthetic construct
EAAAKEAAAKEAAAKEAAAKEAAAK

SEQ ID NO: 14207 - protein, 11 aa, synthetic construct
GSSEAAAKGGG

SEQ ID NO: 14208 - protein, 15 aa, synthetic construct
GGGGSEAAAKGGGGS

SEQ ID NO: 14209 - protein, 9 aa, synthetic construct
GGSGGSGGS

SEQ ID NO: 14210 - protein, 9 aa, synthetic construct
GGGGGSGSS

SEQ ID NO: 14211 - protein, 20 aa, synthetic construct
GGGGSGGGGSGGGGSGGGGS

SEQ ID NO: 14212 - protein, 8 aa, synthetic construct
EAAAKGGG

SEQ ID NO: 14213 - protein, 11 aa, synthetic construct
GGSEAAAKGGG

SEQ ID NO: 14214 - protein, 9 aa, synthetic construct
GSSGGSGGG

SEQ ID NO: 14215 - protein, 6 aa, synthetic construct
GGGGGS

SEQ ID NO: 14216 - protein, 12 aa, synthetic construct
GSAGSAAGSGEF

SEQ ID NO: 14217 - protein, 11 aa, synthetic construct
PAPEAAAKGSS

SEQ ID NO: 14218 - protein, 9 aa, synthetic construct
GSSPAPGGG

SEQ ID NO: 14219 - protein, 9 aa, synthetic construct
GGGGSSPAP

SEQ ID NO: 14220 - protein, 9 aa, synthetic construct
PAPGGSGGG

SEQ ID NO: 14221 - protein, 6 aa, synthetic construct
GSSPAP

SEQ ID NO: 14222 - protein, 6 aa, synthetic construct
PAPGSS

SEQ ID NO: 14223 - protein, 9 aa, synthetic construct
GGSGGGGSS

SEQ ID NO: 14224 - protein, 6 aa, synthetic construct
GSSGGS

SEQ ID NO: 14225 - protein, 11 aa, synthetic construct
EAAAKGGGGGS

SEQ ID NO: 14226 - protein, 5 aa, synthetic construct
GGGGG

SEQ ID NO: 14227 - protein, 8 aa, synthetic construct
EAAAKGSS

SEQ ID NO: 14228 - protein, 25 aa, synthetic construct
EAAAKEAAAKEAAAKEAAAKEAAAK

SEQ ID NO: 14229 - protein, 20 aa, synthetic construct
EAAAKEAAAKEAAAKEAAAK

SEQ ID NO: 14230 - protein, 12 aa, synthetic construct
GSAGSAAGSGEF

SEQ ID NO: 14231 - protein, 9 aa, synthetic construct
GGGPAPGGS

SEQ ID NO: 14232 - protein, 11 aa, synthetic construct
GGSEAAAKGGG

SEQ ID NO: 14233 - protein, 11 aa, synthetic construct
PAPGGGEAAAK

SEQ ID NO: 14234 - protein, 11 aa, synthetic construct
EAAAKPAPGSS

SEQ ID NO: 14235 - protein, 8 aa, synthetic construct
GGSEAAAK

SEQ ID NO: 14236 - protein, 6 aa, synthetic construct
GGSGSS

SEQ ID NO: 14237 - protein, 11 aa, synthetic construct
GGSPAPEAAAK

SEQ ID NO: 14238 - protein, 5 aa, synthetic construct
GGGGS

SEQ ID NO: 14239 - protein, 9 aa, synthetic construct
GGSPAPGGG

SEQ ID NO: 14240 - protein, 11 aa, synthetic construct
EAAAKPAPGGS

SEQ ID NO: 14241 - protein, 6 aa, synthetic construct
GSSPAP

SEQ ID NO: 14242 - protein, 9 aa, synthetic construct
GGSGSSGGG

SEQ ID NO: 14243 - protein, 6 aa, synthetic construct
PAPGGG

SEQ ID NO: 14244 - protein, 11 aa, synthetic construct
GSSGGSEAAAK

SEQ ID NO: 14245 - protein, 8 aa, synthetic construct
GGSEAAAK

SEQ ID NO: 14246 - protein, 9 aa, synthetic construct
GGGPAPGGS

SEQ ID NO: 14247 - protein, 12 aa, synthetic construct
GSAGSAAGSGEF

SEQ ID NO: 14248 - protein, 11 aa, synthetic construct
EAAAKPAPGGS

SEQ ID NO: 14249 - protein, 6 aa, synthetic construct
PAPGGG

SEQ ID NO: 14250 - protein, 11 aa, synthetic construct
GSSPAPEAAAK

SEQ ID NO: 14251 - protein, 8 aa, synthetic construct
PAPEAAAK

SEQ ID NO: 14252 - protein, 9 aa, synthetic construct
PAPGGGGGS

SEQ ID NO: 14253 - protein, 11 aa, synthetic construct
GGSEAAAKPAP

SEQ ID NO: 14254 - protein, 8 aa, synthetic construct
EAAAKGSS

SEQ ID NO: 14255 - protein, 8 aa, synthetic construct
GGGEAAAK

SEQ ID NO: 14256 - protein, 15 aa, synthetic construct
EAAAKEAAAKEAAAK

SEQ ID NO: 14257 - protein, 11 aa, synthetic construct
PAPEAAAKGGG

SEQ ID NO: 14258 - protein, 7 aa, synthetic construct
PAPAPAP

SEQ ID NO: 14259 - protein, 11 aa, synthetic construct
EAAAKPAPGGS

SEQ ID NO: 14260 - protein, 10 aa, synthetic construct
GGGGSGGGGS

SEQ ID NO: 14261 - protein, 15 aa, synthetic construct
GGGGSEAAAKGGGGS

SEQ ID NO: 14262 - protein, 5 aa, synthetic construct
EAAAK

SEQ ID NO: 14263 - protein, 7 aa, synthetic construct
PAPAPAP

SEQ ID NO: 14264 - protein, 15 aa, synthetic construct
GGGGSEAAAKGGGGS

SEQ ID NO: 14265 - protein, 11 aa, synthetic construct
GGSPAPEAAAK

SEQ ID NO: 14266 - protein, 9 aa, synthetic construct
GGSGSSGGG

SEQ ID NO: 14267 - protein, 9 aa, synthetic construct
GGSPAPGSS

SEQ ID NO: 14268 - protein, 33 aa, synthetic construct; identical to SEQ ID NO: 5006

SEQ ID NO: 14269 - protein, 11 aa, synthetic construct
EAAAKGGGPAP

SEQ ID NO: 14270 - protein, 11 aa, synthetic construct
GSSGGSEAAAK

SEQ ID NO: 14271 - protein, 16 aa, synthetic construct
SGSETPGTSESATPES

SEQ ID NO: 14272 - protein, 25 aa, synthetic construct
EAAAKEAAAKEAAAKEAAAKEAAAK

SEQ ID NO: 14273 - protein, 9 aa, synthetic construct
GSSGSSGSS

SEQ ID NO: 14274 - protein, 9 aa, synthetic construct
GSSPAPGGG

SEQ ID NO: 14275 - protein, 11 aa, synthetic construct
GSSGGGEAAAK

SEQ ID NO: 14276 - protein, 9 aa, synthetic construct
GGSGGGGSS

SEQ ID NO: 14277 - protein, 11 aa, synthetic construct
GSSGGGEAAAK

SEQ ID NO: 14278 - protein, 11 aa, synthetic construct
GSSEAAAKGGG

SEQ ID NO: 14279 - protein, 9 aa, synthetic construct
GGSGGGGSS

SEQ ID NO: 14280 - protein, 9 aa, synthetic construct
GGSGSSPAP

SEQ ID NO: 14281 - protein, 6 aa, synthetic construct
GSSPAP

SEQ ID NO: 14282 - protein, 11 aa, synthetic construct
GGGGSSEAAAK

SEQ ID NO: 14283 - skipped

SEQ ID NO: 14284 - protein, 10 aa, synthetic construct
EAAAKEAAAK

SEQ ID NO: 14285 - protein, 9 aa, synthetic construct
PAPAPAPAP

SEQ ID NO: 14286 - protein, 11 aa, synthetic construct
GGSEAAAKGGG

SEQ ID NO: 14287 - protein, 6 aa, synthetic construct
PAPGGG

SEQ ID NO: 14288 - protein, 8 aa, synthetic construct
EAAAKGSS

SEQ ID NO: 14289 - protein, 10 aa, synthetic construct
GGGGSGGGGS

SEQ ID NO: 14290 - protein, 9 aa, synthetic construct
GGSGGSGGS

SEQ ID NO: 14291 - protein, 5 aa, synthetic construct
EAAAK

SEQ ID NO: 14292 - protein, 9 aa, synthetic construct
GGGGSSGGS

SEQ ID NO: 14293 - protein, 11 aa, synthetic construct
GGGPAPEAAAK

SEQ ID NO: 14294 - protein, 15 aa, synthetic construct
EAAAKEAAAKEAAAK

SEQ ID NO: 14295 - protein, 11 aa, synthetic construct
GSSEAAAKGGG

SEQ ID NO: 14296 - protein, 9 aa, synthetic construct
GGGPAPGGS

SEQ ID NO: 14297 - protein, 11 aa, synthetic construct
GGSEAAAKGGG

SEQ ID NO: 14298 - protein, 11 aa, synthetic construct
EAAAKGGGGGS

SEQ ID NO: 14299 - protein, 11 aa, synthetic construct
EAAAKGGSGGG

SEQ ID NO: 14300 - protein, 11 aa, synthetic construct
GGSEAAAKGGG

SEQ ID NO: 14301 - protein, 5 aa, synthetic construct
GGGGS

SEQ ID NO: 14302 - protein, 6 aa, synthetic construct
GSSGGS

SEQ ID NO: 14303 - protein, 6 aa, synthetic construct
GSSGSS

SEQ ID NO: 14304 - protein, 9 aa, synthetic construct
GGSPAPGGG

SEQ ID NO: 14305 - protein, 9 aa, synthetic construct
GSSGGGGGS

SEQ ID NO: 14306 - protein, 9 aa, synthetic construct
PAPAPAPAP

SEQ ID NO: 14307 - protein, 5 aa, synthetic construct
PAPAP

SEQ ID NO: 14308 - protein, 9 aa, synthetic construct
PAPGSSGGS

SEQ ID NO: 14309 - protein, 9 aa, synthetic construct
PAPGSSGGG

SEQ ID NO: 14310 - protein, 8 aa, synthetic construct
GGGEAAAK

SEQ ID NO: 14311 - protein, 15 aa, synthetic construct
GGSGGSGGSGGSGGS

SEQ ID NO: 14312 - protein, 6 aa, synthetic construct
GGSGGG

SEQ ID NO: 14313 - protein, 11 aa, synthetic construct
PAPEAAAKGGG

SEQ ID NO: 14314 - skipped

SEQ ID NO: 14315 - protein, 9 aa, synthetic construct
PAPGGSGSS

SEQ ID NO: 14316 - protein, 30 aa, synthetic construct; identical to SEQ ID NO: 5130

SEQ ID NO: 14317 - protein, 12 aa, synthetic construct
GSSGSSGSSGSS

SEQ ID NO: 14318 - protein, 15 aa, synthetic construct
GSSGSSGSSGSSGSS

SEQ ID NO: 14319 - protein, 11 aa, synthetic construct
GGGEAAAKPAP

SEQ ID NO: 14320 - protein, 9 aa, synthetic construct
PAPGSSGGG

SEQ ID NO: 14321 - protein, 9 aa, synthetic construct
PAPGGSGSS

SEQ ID NO: 14322 - protein, 11 aa, synthetic construct
PAPAPAPAPAP

SEQ ID NO: 14323 - protein, 11 aa, synthetic construct
GGSGGGEAAAK

SEQ ID NO: 14324 - protein, 6 aa, synthetic construct
GSSPAP

SEQ ID NO: 14325 - protein, 8 aa, synthetic construct
EAAAKPAP

SEQ ID NO: 14326 - protein, 20 aa, synthetic construct
GGGGSGGGGSGGGGSGGGGS

SEQ ID NO: 14327 - protein, 6 aa, synthetic construct
GGSGGG

SEQ ID NO: 14328 - protein, 9 aa, synthetic construct
GGSGGSGGS

SEQ ID NO: 14329 - protein, 8 aa, synthetic construct
GGGGGGGG

SEQ ID NO: 14330 - protein, 6 aa, synthetic construct
GGGGSS

SEQ ID NO: 14331 - protein, 9 aa, synthetic construct
GSSGGGGGS

SEQ ID NO: 14332 - protein, 30 aa, synthetic construct; identical to SEQ ID NO: 5130

SEQ ID NO: 14333 - protein, 9 aa, synthetic construct
GSSGSSGSS

SEQ ID NO: 14334 - protein, 9 aa, synthetic construct
GSSPAPGGS

SEQ ID NO: 14335 - protein, 7 aa, synthetic construct
PAPAPAP

SEQ ID NO: 14336 - protein, 20 aa, synthetic construct
EAAAKEAAAKEAAAKEAAAK

SEQ ID NO: 14337 - protein, 9 aa, synthetic construct
PAPAPAPAP

SEQ ID NO: 14338 - protein, 6 aa, synthetic construct
GGGGSS

SEQ ID NO: 14339 - protein, 15 aa, synthetic construct
GSSGSSGSSGSSGSS

SEQ ID NO: 14340 - protein, 6 aa, synthetic construct
PAPGGS

SEQ ID NO: 14341 - protein, 11 aa, synthetic construct
GSSEAAAKGGG

SEQ ID NO: 14342 - protein, 9 aa, synthetic construct
GSSGGSPAP

SEQ ID NO: 14343 - protein, 18 aa, synthetic construct
GSSGSSGSSGSSGSSGSS

SEQ ID NO: 14344 - protein, 9 aa, synthetic construct
GGSGSSGGG

SEQ ID NO: 14345 - protein, 9 aa, synthetic construct
GGGPAPGSS

SEQ ID NO: 14346 - protein, 11 aa, synthetic construct
GSSEAAAKGGS

SEQ ID NO: 14347 - protein, 11 aa, synthetic construct
GSSEAAAKGGG

SEQ ID NO: 14348 - protein, 9 aa, synthetic construct
GGSGGGPAP

SEQ ID NO: 14349 - protein, 6 aa, synthetic construct
GSSGSS

SEQ ID NO: 14350 - protein, 9 aa, synthetic construct
PAPGGGGGS

SEQ ID NO: 14351 - protein, 11 aa, synthetic construct
EAAAKPAPGGS

SEQ ID NO: 14352 - protein, 6 aa, synthetic construct
GSSGSS

SEQ ID NO: 14353 - protein, 11 aa, synthetic construct
EAAAKPAPGGS

SEQ ID NO: 14354 - protein, 11 aa, synthetic construct
GGGPAPEAAAK

SEQ ID NO: 14355 - protein, 11 aa, synthetic construct
GSSEAAAKGGG

SEQ ID NO: 14356 - protein, 11 aa, synthetic construct
GGGEAAAKGGS

SEQ ID NO: 14357 - protein, 6 aa, synthetic construct
GSSGSS

SEQ ID NO: 14358 - protein, 15 aa, synthetic construct
EAAAKEAAAKEAAAK

SEQ ID NO: 14359 - protein, 9 aa, synthetic construct
PAPGSSGGS

SEQ ID NO: 14360 - protein, 11 aa, synthetic construct
PAPAPAPAPAP

SEQ ID NO: 14361 - protein, 8 aa, synthetic construct
GSSEAAAK

SEQ ID NO: 14362 - skipped

SEQ ID NO: 14363 - protein, 11 aa, synthetic construct
GGSEAAAKGGG

SEQ ID NO: 14364 - protein, 9 aa, synthetic construct
GGSGGGPAP

SEQ ID NO: 14365 - protein, 6 aa, synthetic construct
GSSGSS

SEQ ID NO: 14366 - protein, 8 aa, synthetic construct
GGSEAAAK

SEQ ID NO: 14367 - protein, 11 aa, synthetic construct
GSSEAAAKGGS

SEQ ID NO: 14368 - protein, 9 aa, synthetic construct
PAPGGGGGS

SEQ ID NO: 14369 - protein, 6 aa, synthetic construct
GSSGGG

SEQ ID NO: 14370 - protein, 6 aa, synthetic construct
GSSGGS

SEQ ID NO: 14371 - protein, 6 aa, synthetic construct
PAPGGG

SEQ ID NO: 14372 - protein, 9 aa, synthetic construct
PAPGSSGGG

SEQ ID NO: 14373 - protein, 8 aa, synthetic construct
GGSEAAAK

SEQ ID NO: 14374 - protein, 11 aa, synthetic construct
GSSPAPEAAAK

SEQ ID NO: 14375 - protein, 9 aa, synthetic construct
GSSGGSPAP

SEQ ID NO: 14376 - protein, 9 aa, synthetic construct
GGSPAPGSS

SEQ ID NO: 14377 - protein, 9 aa, synthetic construct
GGSGGSGGS

SEQ ID NO: 14378 - protein, 9 aa, synthetic construct
GGSGGGPAP

SEQ ID NO: 14379 - protein, 11 aa, synthetic construct
GGGPAPEAAAK

SEQ ID NO: 14380 - protein, 5 aa, synthetic construct
GGGGS

SEQ ID NO: 14381 - protein, 9 aa, synthetic construct
GSSGGSGGG

SEQ ID NO: 14382 - protein, 11 aa, synthetic construct
EAAAKGGGGSS

SEQ ID NO: 14383 - protein, 9 aa, synthetic construct
GGSGSSGGG

SEQ ID NO: 14384 - protein, 9 aa, synthetic construct
GGSGGSGGS

SEQ ID NO: 14385 - protein, 11 aa, synthetic construct
GGGPAPEAAAK

SEQ ID NO: 14386 - protein, 11 aa, synthetic construct
GSSGGGEAAAK

SEQ ID NO: 14387 - skipped

SEQ ID NO: 14388 - protein, 12 aa, synthetic construct
GSAGSAAGSGEF

SEQ ID NO: 14389 - protein, 9 aa, synthetic construct
GSSGGGPAP

SEQ ID NO: 14390 - protein, 6 aa, synthetic construct
GGGGSS

SEQ ID NO: 14391 - protein, 11 aa, synthetic construct
GGGGSSEAAAK

SEQ ID NO: 14392 - protein, 9 aa, synthetic construct
PAPGGSGGG

SEQ ID NO: 14393 - protein, 15 aa, synthetic construct
GSSGSSGSSGSSGSS

SEQ ID NO: 14394 - protein, 9 aa, synthetic construct
GSSGGSPAP

SEQ ID NO: 14395 - protein, 8 aa, synthetic construct
GGSEAAAK

SEQ ID NO: 14396 - protein, 10 aa, synthetic construct
GGGGSGGGGS

SEQ ID NO: 14397 - protein, 11 aa, synthetic construct
GSSEAAAKGGG

SEQ ID NO: 14398 - protein, 11 aa, synthetic construct
EAAAKPAPGGG

SEQ ID NO: 14399 - protein, 11 aa, synthetic construct
EAAAKGGSPAP

SEQ ID NO: 14400 - protein, 11 aa, synthetic construct
GSSEAAAKPAP

SEQ ID NO: 14401 - protein, 9 aa, synthetic construct
GGGPAPGGS

SEQ ID NO: 14402 - skipped

SEQ ID NO: 14403 - protein, 15 aa, synthetic construct
EAAAKGGGGSEAAAK

SEQ ID NO: 14404 - protein, 9 aa, synthetic construct
GGSGSSGGG

SEQ ID NO: 14405 - protein, 12 aa, synthetic construct
GSAGSAAGSGEF

SEQ ID NO: 14406 - protein, 8 aa, synthetic construct
GGGEAAAK

SEQ ID NO: 14407 - protein, 11 aa, synthetic construct
PAPEAAAKGGS

SEQ ID NO: 14408 - protein, 13 aa, synthetic construct
PAPAPAPAPAPAP

SEQ ID NO: 14409 - protein, 9 aa, synthetic construct
GGSGGGGSS

SEQ ID NO: 14410 - protein, 9 aa, synthetic construct
PAPGSSGGS

SEQ ID NO: 14411 - protein, 8 aa, synthetic construct
PAPEAAAK

SEQ ID NO: 14412 - protein, 18 aa, synthetic construct
GSSGSSGSSGSSGSSGSS

SEQ ID NO: 14413 - protein, 9 aa, synthetic construct
GGGGGSGSS

SEQ ID NO: 14414 - protein, 8 aa, synthetic construct
GGGGGGGG

SEQ ID NO: 14415 - protein, 6 aa, synthetic construct
GGGGGG

SEQ ID NO: 14416 - protein, 9 aa, synthetic construct
GSSGGSGGG

SEQ ID NO: 14417 - protein, 6 aa, synthetic construct
GGGGSS

SEQ ID NO: 14418 - protein, 9 aa, synthetic construct
GGSGGGPAP

SEQ ID NO: 14419 - protein, 6 aa, synthetic construct
GSSGSS

SEQ ID NO: 14420 - protein, 25 aa, synthetic construct
EAAAKEAAAKEAAAKEAAAKEAAAK

SEQ ID NO: 14421 - protein, 10 aa, synthetic construct
EAAAKEAAAK

SEQ ID NO: 14422 - protein, 11 aa, synthetic construct
GSSPAPEAAAK

SEQ ID NO: 14423 - protein, 11 aa, synthetic construct
GGSEAAAKPAP

SEQ ID NO: 14424 - protein, 11 aa, synthetic construct
GGSGGGEAAAK

SEQ ID NO: 14425 - protein, 11 aa, synthetic construct
EAAAKGSSPAP

SEQ ID NO: 14426 - protein, 11 aa, synthetic construct
GGSGSSEAAAK

SEQ ID NO: 14427 - skipped

SEQ ID NO: 14428 - protein, 9 aa, synthetic construct
GGGGGSGSS

SEQ ID NO: 14429 - protein, 11 aa, synthetic construct
GGSGGGEAAAK

SEQ ID NO: 14430 - protein, 9 aa, synthetic construct
GSSGGSGGG

SEQ ID NO: 14431 - protein, 11 aa, synthetic construct
EAAAKPAPGGG

SEQ ID NO: 14432 - protein, 9 aa, synthetic construct
PAPGGSGGG

SEQ ID NO: 14433 - protein, 7 aa, synthetic construct
PAPAPAP

SEQ ID NO: 14434 - protein, 11 aa, synthetic construct
GSSEAAAKPAP

SEQ ID NO: 14435 - protein, 33 aa, synthetic construct; identical to SEQ ID NO: 5006

SEQ ID NO: 14436 - protein, 9 aa, synthetic construct
GSSGGSGGG

SEQ ID NO: 14437 - protein, 18 aa, synthetic construct
GSSGSSGSSGSSGSSGSS

SEQ ID NO: 14438 - protein, 9 aa, synthetic construct
GSSGGGPAP

SEQ ID NO: 14439 - protein, 13 aa, synthetic construct
PAPAPAPAPAPAP

SEQ ID NO: 14440 - protein, 9 aa, synthetic construct
GGGGGSPAP

SEQ ID NO: 14441 - protein, 6 aa, synthetic construct
PAPGSS

SEQ ID NO: 14442 - protein, 11 aa, synthetic construct
PAPEAAAKGGS

SEQ ID NO: 14443 - protein, 9 aa, synthetic construct
GGGGSSPAP

SEQ ID NO: 14444 - protein, 8 aa, synthetic construct
GGSEAAAK

SEQ ID NO: 14445 - protein, 11 aa, synthetic construct
EAAAKPAPGGS

SEQ ID NO: 14446 - protein, 6 aa, synthetic construct
PAPGSS

SEQ ID NO: 14447 - protein, 9 aa, synthetic construct
PAPGSSGGG

SEQ ID NO: 14448 - protein, 15 aa, synthetic construct
EAAAKEAAAKEAAAK

SEQ ID NO: 14449 - skipped

SEQ ID NO: 14450 - protein, 5 aa, synthetic construct
GGGGS

SEQ ID NO: 14451 - protein, 9 aa, synthetic construct
GGSGGGGSS

SEQ ID NO: 14452 - protein, 6 aa, synthetic construct
GGSGGG

SEQ ID NO: 14453 - protein, 11 aa, synthetic construct
GGGEAAAKPAP

SEQ ID NO: 14454 - protein, 25 aa, synthetic construct
EAAAKEAAAKEAAAKEAAAKEAAAK

SEQ ID NO: 14455 - protein, 9 aa, synthetic construct
PAPGGSGGG

SEQ ID NO: 14456 - protein, 18 aa, synthetic construct
GSSGSSGSSGSSGSSGSS

SEQ ID NO: 14457 - protein, 11 aa, synthetic construct
GGGEAAAKPAP

SEQ ID NO: 14458 - protein, 9 aa, synthetic construct
GSSGGSPAP

SEQ ID NO: 14459 - protein, 11 aa, synthetic construct
PAPAPAPAPAP

SEQ ID NO: 14460 - protein, 11 aa, synthetic construct
GSSGGSEAAAK

SEQ ID NO: 14461 - protein, 9 aa, synthetic construct
GGSPAPGSS

SEQ ID NO: 14462 - protein, 9 aa, synthetic construct
GGSGGSGGS

SEQ ID NO: 14463 - protein, 11 aa, synthetic construct
PAPEAAAKGSS

SEQ ID NO: 14464 - protein, 8 aa, synthetic construct
EAAAKGGS

SEQ ID NO: 14465 - protein, 15 aa, synthetic construct
EAAAKGGGGSEAAAK

SEQ ID NO: 14466 - protein, 9 aa, synthetic construct
GGGGSSPAP

SEQ ID NO: 14467 - protein, 5 aa, synthetic construct
EAAAK

SEQ ID NO: 14468 - protein, 11 aa, synthetic construct
EAAAKGGGGSS

SEQ ID NO: 14469 - protein, 11 aa, synthetic construct
GGGGGSEAAAK

SEQ ID NO: 14470 - protein, 4 aa, synthetic construct
GGGG

SEQ ID NO: 14471 - protein, 11 aa, synthetic construct
GGGGGSEAAAK

SEQ ID NO: 14472 - protein, 11 aa, synthetic construct
EAAAKGGGPAP

SEQ ID NO: 14473 - protein, 20 aa, synthetic construct
GGGGSGGGGSGGGGSGGGGS

SEQ ID NO: 14474 - protein, 9 aa, synthetic construct
GSSGGSGGG

SEQ ID NO: 14475 - protein, 15 aa, synthetic construct
GGGGSGGGGSGGGGS

SEQ ID NO: 14476 - protein, 11 aa, synthetic construct
GGSGGGEAAAK

SEQ ID NO: 14477 - protein, 11 aa, synthetic construct
PAPEAAAKGGG

SEQ ID NO: 14478 - protein, 10 aa, synthetic construct
GGGGSGGGGS

SEQ ID NO: 14479 - protein, 11 aa, synthetic construct
GSSGGGEAAAK

SEQ ID NO: 14480 - protein, 5 aa, synthetic construct
GGGGG

SEQ ID NO: 14481 - protein, 6 aa, synthetic construct
GGSGSS

SEQ ID NO: 14482 - protein, 13 aa, synthetic construct
PAPAPAPAPAPAP

SEQ ID NO: 14483 - protein, 11 aa, synthetic construct
GGSEAAAKPAP

SEQ ID NO: 14484 - protein, 6 aa, synthetic construct
GGGGGG

SEQ ID NO: 14485 - protein, 11 aa, synthetic construct
GSSGGGEAAAK

SEQ ID NO: 14486 - protein, 33 aa, synthetic construct; identical to SEQ ID NO: 5006

SEQ ID NO: 14487 - protein, 9 aa, synthetic construct
GGSPAPGSS

SEQ ID NO: 14488 - protein, 9 aa, synthetic construct
GGGGSSPAP

SEQ ID NO: 14489 - protein, 15 aa, synthetic construct
GGGGSEAAAKGGGGS

SEQ ID NO: 14490 - protein, 8 aa, synthetic construct
GGGGGGGG

SEQ ID NO: 14491 - protein, 5 aa, synthetic construct
PAPAP

SEQ ID NO: 14492 - protein, 8 aa, synthetic construct
GGGEAAAK

SEQ ID NO: 14493 - protein, 9 aa, synthetic construct
GSSPAPGGG

SEQ ID NO: 14494 - protein, 15 aa, synthetic construct
GGSGGSGGSGGSGGS

SEQ ID NO: 14495 - protein, 6 aa, synthetic construct
GGGGGS

SEQ ID NO: 14496 - protein, 9 aa, synthetic construct
PAPGGGGSS

SEQ ID NO: 14497 - protein, 8 aa, synthetic construct
GGGEAAAK

SEQ ID NO: 14498 - protein, 11 aa, synthetic construct
PAPEAAAKGGG

SEQ ID NO: 14499 - protein, 8 aa, synthetic construct
GSSEAAAK

SEQ ID NO: 14500 - protein, 10 aa, synthetic construct
EAAAKEAAAK

SEQ ID NO: 14501 - protein, 11 aa, synthetic construct
EAAAKGGGGGS

SEQ ID NO: 14502 - protein, 11 aa, synthetic construct
GGGEAAAKGGS

SEQ ID NO: 14503 - protein, 11 aa, synthetic construct
PAPAPAPAPAP

SEQ ID NO: 14504 - protein, 11 aa, synthetic construct
PAPGSSEAAAK

SEQ ID NO: 14505 - protein, 15 aa, synthetic construct
EAAAKEAAAKEAAAK

SEQ ID NO: 14506 - protein, 9 aa, synthetic construct
GGSPAPGSS

SEQ ID NO: 14507 - protein, 9 aa, synthetic construct
PAPGSSGGS

SEQ ID NO: 14508 - protein, 20 aa, synthetic construct
EAAAKEAAAKEAAAKEAAAK

SEQ ID NO: 14509 - protein, 8 aa, synthetic construct
EAAAKGGG

SEQ ID NO: 14510 - protein, 11 aa, synthetic construct
EAAAKGGSGGG

SEQ ID NO: 14511 - protein, 6 aa, synthetic construct
GGGGGS

SEQ ID NO: 14512 - protein, 9 aa, synthetic construct
PAPGGSGGG

SEQ ID NO: 14513 - protein, 9 aa, synthetic construct
GGGPAPGGS

SEQ ID NO: 14514 - skipped

SEQ ID NO: 14515 - protein, 9 aa, synthetic construct
GGSGGSGGS

SEQ ID NO: 14516 - protein, 5 aa, synthetic construct
GGGGS

SEQ ID NO: 14517 - protein, 4 aa, synthetic construct
GGGG

SEQ ID NO: 14518 - protein, 11 aa, synthetic construct
GGSEAAAKPAP

SEQ ID NO: 14519 - protein, 9 aa, synthetic construct
PAPAPAPAP

SEQ ID NO: 14520 - skipped

SEQ ID NO: 14521 - protein, 15 aa, synthetic construct
EAAAKEAAAKEAAAK

SEQ ID NO: 14522 - protein, 8 aa, synthetic construct
EAAAKGSS

SEQ ID NO: 14523 - protein, 8 aa, synthetic construct
EAAAKGGG

SEQ ID NO: 14524 - protein, 11 aa, synthetic construct
PAPEAAAKGGG

SEQ ID NO: 14525 - protein, 11 aa, synthetic construct
GSSGGGEAAAK

SEQ ID NO: 14526 - protein, 11 aa, synthetic construct
PAPGGGEAAAK

SEQ ID NO: 14527 - protein, 20 aa, synthetic construct
GGGGSGGGGSGGGGSGGGGS

SEQ ID NO: 14528 - protein, 6 aa, synthetic construct
GSSGGG

SEQ ID NO: 14529 - protein, 20 aa, synthetic construct
GGGGSGGGGSGGGGSGGGGS

SEQ ID NO: 14530 - protein, 6 aa, synthetic construct
GGSGSS

SEQ ID NO: 14531 - protein, 11 aa, synthetic construct
GGSGSSEAAAK

SEQ ID NO: 14532 - protein, 7 aa, synthetic construct
PAPAPAP

SEQ ID NO: 14533 - protein, 9 aa, synthetic construct
GSSGGSPAP

SEQ ID NO: 14534 - protein, 6 aa, synthetic construct
GGSPAP

SEQ ID NO: 14535 - protein, 9 aa, synthetic construct
GGSGGGPAP

SEQ ID NO: 14536 - protein, 8 aa, synthetic construct
GSSEAAAK

SEQ ID NO: 14537 - protein, 9 aa, synthetic construct
GSSGGGPAP

SEQ ID NO: 14538 - protein, 11 aa, synthetic construct
GGGGSSEAAAK

SEQ ID NO: 14539 - protein, 11 aa, synthetic construct
GGSEAAAKPAP

SEQ ID NO: 14540 - protein, 9 aa, synthetic construct
GGSGGGPAP

SEQ ID NO: 14541 - protein, 20 aa, synthetic construct
GGGGSGGGGSGGGGSGGGGS

SEQ ID NO: 14542 - protein, 9 aa, synthetic construct
GGGGSSPAP

SEQ ID NO: 14543 - protein, 8 aa, synthetic construct
EAAAKGGS

SEQ ID NO: 14544 - protein, 11 aa, synthetic construct
GGSEAAAKGSS

SEQ ID NO: 14545 - protein, 11 aa, synthetic construct
GGGGSSEAAAK

SEQ ID NO: 14546 - protein, 11 aa, synthetic construct
EAAAKGGSGGG

SEQ ID NO: 14547 - protein, 6 aa, synthetic construct
GGSGGS

SEQ ID NO: 14548 - protein, 8 aa, synthetic construct
EAAAKGGG

SEQ ID NO: 14549 - protein, 15 aa, synthetic construct
GSSGSSGSSGSSGSS

SEQ ID NO: 14550 - protein, 9 aa, synthetic construct
GSSGGGPAP

SEQ ID NO: 14551 - protein, 11 aa, synthetic construct
PAPGGSEAAAK

SEQ ID NO: 14552 - protein, 6 aa, synthetic construct
GGSPAP

SEQ ID NO: 14553 - protein, 11 aa, synthetic construct
EAAAKPAPGSS

SEQ ID NO: 14554 - protein, 16 aa, synthetic construct
SGSETPGTSESATPES

SEQ ID NO: 14555 - protein, 6 aa, synthetic construct
GSSPAP

SEQ ID NO: 14556 - protein, 9 aa, synthetic construct
GSSPAPGGG

SEQ ID NO: 14557 - protein, 11 aa, synthetic construct
GGGEAAAKGSS

SEQ ID NO: 14558 - protein, 9 aa, synthetic construct
GGGPAPGGS

SEQ ID NO: 14559 - protein, 8 aa, synthetic construct
EAAAKGGG

SEQ ID NO: 14560 - protein, 6 aa, synthetic construct
GSSGGG

SEQ ID NO: 14561 - protein, 11 aa, synthetic construct
GGSPAPEAAAK

SEQ ID NO: 14562 - protein, 11 aa, synthetic construct
EAAAKGSSPAP

SEQ ID NO: 14563 - protein, 15 aa, synthetic construct
EAAAKGGGGSEAAAK

SEQ ID NO: 14564 - protein, 15 aa, synthetic construct
GSSGSSGSSGSSGSS

SEQ ID NO: 14565 - protein, 11 aa, synthetic construct
EAAAKGGSPAP

SEQ ID NO: 14566 - protein, 6 aa, synthetic construct
GGSGGS

SEQ ID NO: 14567 - protein, 11 aa, synthetic construct
EAAAKGSSGGS

SEQ ID NO: 14568 - protein, 9 aa, synthetic construct
GSSGGGPAP

SEQ ID NO: 14569 - protein, 11 aa, synthetic construct
PAPEAAAKGGS

SEQ ID NO: 14570 - protein, 11 aa, synthetic construct
EAAAKPAPGGG

SEQ ID NO: 14571 - protein, 6 aa, synthetic construct
GGSPAP

SEQ ID NO: 14572 - protein, 10 aa, synthetic construct
GGGGSGGGGS

SEQ ID NO: 14573 - protein, 6 aa, synthetic construct
GGGGSS

SEQ ID NO: 14574 - protein, 9 aa, synthetic construct
GGSPAPGGG

SEQ ID NO: 14575 - protein, 11 aa, synthetic construct
EAAAKPAPGSS

SEQ ID NO: 14576 - protein, 8 aa, synthetic construct
EAAAKPAP

SEQ ID NO: 14577 - protein, 11 aa, synthetic construct
PAPEAAAKGSS

SEQ ID NO: 14578 - protein, 11 aa, synthetic construct
EAAAKGGSGSS

SEQ ID NO: 14579 - protein, 11 aa, synthetic construct
GGGEAAAKGSS

SEQ ID NO: 14580 - protein, 15 aa, synthetic construct
GGGGSEAAAKGGGGS

SEQ ID NO: 14581 - protein, 9 aa, synthetic construct
PAPGGSGSS

SEQ ID NO: 14582 - protein, 11 aa, synthetic construct
GGSEAAAKPAP

SEQ ID NO: 14583 - protein, 15 aa, synthetic construct
GGSGGSGGSGGSGGS

SEQ ID NO: 14584 - protein, 11 aa, synthetic construct
GSSGGSEAAAK

SEQ ID NO: 14585 - skipped

SEQ ID NO: 14586 - protein, 11 aa, synthetic construct
PAPGGSEAAAK

SEQ ID NO: 14587 - protein, 11 aa, synthetic construct
PAPEAAAKGGS

SEQ ID NO: 14588 - protein, 9 aa, synthetic construct
GGSGSSPAP

SEQ ID NO: 14589 - protein, 6 aa, synthetic construct
GSSPAP

SEQ ID NO: 14590 - protein, 8 aa, synthetic construct
GGGEAAAK

SEQ ID NO: 14591 - protein, 6 aa, synthetic construct
GGGGSS

SEQ ID NO: 14592 - protein, 9 aa, synthetic construct
GGSPAPGSS

SEQ ID NO: 14593 - protein, 6 aa, synthetic construct
PAPGGS

SEQ ID NO: 14594 - protein, 11 aa, synthetic construct
EAAAKGSSPAP

SEQ ID NO: 14595 - protein, 9 aa, synthetic construct
GGGGSSGGS

SEQ ID NO: 14596 - protein, 13 aa, synthetic construct
PAPAPAPAPAPAP

SEQ ID NO: 14597 - protein, 11 aa, synthetic construct
GGSEAAAKGGG

SEQ ID NO: 14598 - protein, 6 aa, synthetic construct
GGSGGS

SEQ ID NO: 14599 - protein, 9 aa, synthetic construct
GSSGGGGGS

SEQ ID NO: 14600 - protein, 11 aa, synthetic construct
EAAAKGGGPAP

SEQ ID NO: 14601 - protein, 20 aa, synthetic construct
EAAAKEAAAKEAAAKEAAAK

SEQ ID NO: 14602 - protein, 9 aa, synthetic construct
GGGPAPGSS

SEQ ID NO: 14603 - protein, 20 aa, synthetic construct
GGGGSGGGGSGGGGSGGGGS

SEQ ID NO: 14604 - protein, 20 aa, synthetic construct
EAAAKEAAAKEAAAKEAAAK

SEQ ID NO: 14605 - protein, 9 aa, synthetic construct
PAPGSSGGS

SEQ ID NO: 14606 - protein, 11 aa, synthetic construct
PAPGSSEAAAK

SEQ ID NO: 14607 - protein, 11 aa, synthetic construct
GSSPAPEAAAK

SEQ ID NO: 14608 - protein, 15 aa, synthetic construct
EAAAKGGGGSEAAAK

SEQ ID NO: 14609 - protein, 6 aa, synthetic construct
GGSPAP

SEQ ID NO: 14610 - protein, 11 aa, synthetic construct
GGSGSSEAAAK

SEQ ID NO: 14611 - protein, 11 aa, synthetic construct
GGSEAAAKGGG

SEQ ID NO: 14612 - protein, 9 aa, synthetic construct
PAPGGGGSS

SEQ ID NO: 14613 - protein, 12 aa, synthetic construct
GGSGGSGGSGGS

SEQ ID NO: 14614 - protein, 9 aa, synthetic construct
GGGGSSGGS

SEQ ID NO: 14615 - protein, 33 aa, synthetic construct; identical to SEQ ID NO: 5006

SEQ ID NO: 14616 - protein, 6 aa, synthetic construct
GGGPAP

SEQ ID NO: 14617 - protein, 20 aa, synthetic construct
GGGGSGGGGSGGGGSGGGGS

SEQ ID NO: 14618 - protein, 8 aa, synthetic construct
GSSEAAAK

SEQ ID NO: 14619 - protein, 11 aa, synthetic construct
GGSPAPEAAAK

SEQ ID NO: 14620 - protein, 11 aa, synthetic construct
GGGGGSEAAAK

SEQ ID NO: 14621 - protein, 9 aa, synthetic construct
GSSPAPGGS

SEQ ID NO: 14622 - skipped

SEQ ID NO: 14623 - protein, 8 aa, synthetic construct
EAAAKPAP

SEQ ID NO: 14624 - protein, 8 aa, synthetic construct
EAAAKGGG

SEQ ID NO: 14625 - protein, 8 aa, synthetic construct
GGGEAAAK

SEQ ID NO: 14626 - protein, 9 aa, synthetic construct
PAPGSSGGG

SEQ ID NO: 14627 - protein, 11 aa, synthetic construct
EAAAKGGSPAP

SEQ ID NO: 14628 - protein, 9 aa, synthetic construct
GSSGGSGGG

SEQ ID NO: 14629 - protein, 11 aa, synthetic construct
GSSGGGEAAAK

SEQ ID NO: 14630 - protein, 9 aa, synthetic construct
GGGPAPGSS

SEQ ID NO: 14631 - protein, 11 aa, synthetic construct
PAPGGGEAAAK

SEQ ID NO: 14632 - protein, 12 aa, synthetic construct
GSSGSSGSSGSS

SEQ ID NO: 14633 - protein, 8 aa, synthetic construct
GGSEAAAK

SEQ ID NO: 14634 - protein, 11 aa, synthetic construct
GGGEAAAKPAP

SEQ ID NO: 14635 - protein, 11 aa, synthetic construct
EAAAKGGGPAP

SEQ ID NO: 14636 - protein, 9 aa, synthetic construct
GGGGSSPAP

SEQ ID NO: 14637 - protein, 11 aa, synthetic construct
EAAAKPAPGSS

SEQ ID NO: 14638 - protein, 9 aa, synthetic construct
GGGGSSPAP

SEQ ID NO: 14639 - protein, 6 aa, synthetic construct
GSSGSS

SEQ ID NO: 14640 - protein, 25 aa, synthetic construct
GGGGSGGGGSGGGGSGGGGSGGGGS

SEQ ID NO: 14641 - protein, 9 aa, synthetic construct
GGGGSSGGS

SEQ ID NO: 14642 - protein, 11 aa, synthetic construct
EAAAKGGSGSS

SEQ ID NO: 14643 - protein, 8 aa, synthetic construct
EAAAKPAP

SEQ ID NO: 14644 - protein, 11 aa, synthetic construct
GSSGGGEAAAK

SEQ ID NO: 14645 - protein, 9 aa, synthetic construct
PAPGGSGGG

SEQ ID NO: 14646 - protein, 11 aa, synthetic construct
EAAAKGGGPAP

SEQ ID NO: 14647 - protein, 9 aa, synthetic construct
GSSGSSGSS

SEQ ID NO: 14648 - protein, 6 aa, synthetic construct
GSSGGS

SEQ ID NO: 14649 - protein, 11 aa, synthetic construct
GGSEAAAKGGG

SEQ ID NO: 14650 - protein, 8 aa, synthetic construct
EAAAKGGS

SEQ ID NO: 14651 - protein, 9 aa, synthetic construct
GGSGSSGGG

SEQ ID NO: 14652 - protein, 5 aa, synthetic construct
EAAAK

SEQ ID NO: 14653 - protein, 9 aa, synthetic construct
GSSGGSPAP

SEQ ID NO: 14654 - protein, 9 aa, synthetic construct
GGGGSSGGS

SEQ ID NO: 14655 - protein, 9 aa, synthetic construct
PAPGGSGGG

SEQ ID NO: 14656 - protein, 9 aa, synthetic construct
GGGPAPGGS

SEQ ID NO: 14657 - protein, 11 aa, synthetic construct
GSSPAPEAAAK

SEQ ID NO: 14658 - protein, 9 aa, synthetic construct
GGSGSSPAP

SEQ ID NO: 14659 - protein, 11 aa, synthetic construct
GSSEAAAKGGS

SEQ ID NO: 14660 - protein, 6 aa, synthetic construct
PAPGGG

SEQ ID NO: 14661 - protein, 16 aa, synthetic construct
SGSETPGTSESATPES

SEQ ID NO: 14662 - protein, 5 aa, synthetic construct
GGGGS

SEQ ID NO: 14663 - protein, 11 aa, synthetic construct
GSSGGGEAAAK

SEQ ID NO: 14664 - protein, 15 aa, synthetic construct
EAAAKGGGGSEAAAK

SEQ ID NO: 14665 - protein, 11 aa, synthetic construct
GSSEAAAKPAP

SEQ ID NO: 14666 - protein, 6 aa, synthetic construct
GGGGGG

SEQ ID NO: 14667 - protein, 15 aa, synthetic construct
EAAAKEAAAKEAAAK

SEQ ID NO: 14668 - protein, 11 aa, synthetic construct
EAAAKPAPGSS

SEQ ID NO: 14669 - protein, 11 aa, synthetic construct
GGSGSSEAAAK

SEQ ID NO: 14670 - protein, 8 aa, synthetic construct
GGSEAAAK

SEQ ID NO: 14671 - protein, 11 aa, synthetic construct
GGSPAPEAAAK

SEQ ID NO: 14672 - protein, 9 aa, synthetic construct
GGGPAPGSS

SEQ ID NO: 14673 - protein, 11 aa, synthetic construct
GGGGGSEAAAK

SEQ ID NO: 14674 - protein, 11 aa, synthetic construct
EAAAKPAPGSS

SEQ ID NO: 14675 - protein, 12 aa, synthetic construct
GSSGSSGSSGSS

SEQ ID NO: 14676 - protein, 8 aa, synthetic construct
EAAAKPAP

SEQ ID NO: 14677 - protein, 8 aa, synthetic construct
GGGEAAAK

SEQ ID NO: 14678 - protein, 6 aa, synthetic construct
GGSGGS

SEQ ID NO: 14679 - protein, 11 aa, synthetic construct
EAAAKGSSGGS

SEQ ID NO: 14680 - protein, 16 aa, synthetic construct
SGSETPGTSESATPES

SEQ ID NO: 14681 - protein, 11 aa, synthetic construct
EAAAKGSSGGG

SEQ ID NO: 14682 - protein, 30 aa, synthetic construct; identical to SEQ ID NO: 5130

SEQ ID NO: 14683 - protein, 9 aa, synthetic construct
GGSGGGPAP

SEQ ID NO: 14684 - protein, 9 aa, synthetic construct
PAPAPAPAP

SEQ ID NO: 14685 - protein, 11 aa, synthetic construct
GGGEAAAKGGS

SEQ ID NO: 14686 - protein, 9 aa, synthetic construct
GSSGGSGGG

SEQ ID NO: 14687 - protein, 11 aa, synthetic construct
PAPEAAAKGGS

SEQ ID NO: 14688 - protein, 11 aa, synthetic construct
GGGEAAAKGSS

SEQ ID NO: 14689 - protein, 20 aa, synthetic construct
GGGGSGGGGSGGGGSGGGGS

SEQ ID NO: 14690 - protein, 9 aa, synthetic construct
PAPGSSGGG

SEQ ID NO: 14691 - protein, 9 aa, synthetic construct
GGSGSSGGG

SEQ ID NO: 14692 - protein, 11 aa, synthetic construct
EAAAKPAPGSS

SEQ ID NO: 14693 - protein, 11 aa, synthetic construct
GSSEAAAKGGG

SEQ ID NO: 14694 - protein, 15 aa, synthetic construct
GGSGGSGGSGGSGGS

SEQ ID NO: 14695 - protein, 11 aa, synthetic construct
GGSEAAAKPAP

SEQ ID NO: 14696 - protein, 11 aa, synthetic construct
EAAAKGGSPAP

SEQ ID NO: 14697 - protein, 11 aa, synthetic construct
EAAAKGGGGGS

SEQ ID NO: 14698 - protein, 11 aa, synthetic construct
GSSPAPEAAAK

SEQ ID NO: 14699 - protein, 5 aa, synthetic construct
PAPAP

SEQ ID NO: 14700 - protein, 11 aa, synthetic construct
PAPGGSEAAAK

SEQ ID NO: 14701 - protein, 6 aa, synthetic construct
GGSGSS

SEQ ID NO: 14702 - protein, 11 aa, synthetic construct
GGSEAAAKPAP

SEQ ID NO: 14703 - skipped

SEQ ID NO: 14704 - protein, 33 aa, synthetic construct; identical to SEQ ID NO: 5006

SEQ ID NO: 14705 - protein, 11 aa, synthetic construct
PAPGGGEAAAK

SEQ ID NO: 14706 - protein, 9 aa, synthetic construct
PAPGGGGGS

SEQ ID NO: 14707 - protein, 9 aa, synthetic construct
PAPGGSGSS

SEQ ID NO: 14708 - protein, 11 aa, synthetic construct
GSSGGGEAAAK

SEQ ID NO: 14709 - protein, 11 aa, synthetic construct
GGSEAAAKPAP

SEQ ID NO: 14710 - protein, 5 aa, synthetic construct
GGGGG

SEQ ID NO: 14711 - protein, 11 aa, synthetic construct
GGGEAAAKGSS

SEQ ID NO: 14712 - protein, 15 aa, synthetic construct
GSSGSSGSSGSSGSS

SEQ ID NO: 14713 - protein, 16 aa, synthetic construct
SGSETPGTSESATPES

SEQ ID NO: 14714 - protein, 9 aa, synthetic construct
PAPGSSGGG

SEQ ID NO: 14715 - protein, 9 aa, synthetic construct
GGGGSSPAP

SEQ ID NO: 14716 - protein, 8 aa, synthetic construct
GGGEAAAK

SEQ ID NO: 14717 - protein, 6 aa, synthetic construct
GGSGGG

SEQ ID NO: 14718 - protein, 11 aa, synthetic construct
EAAAKGSSGGG

SEQ ID NO: 14719 - protein, 11 aa, synthetic construct
GSSPAPEAAAK

SEQ ID NO: 14720 - protein, 9 aa, synthetic construct
GGGPAPGSS

SEQ ID NO: 14721 - protein, 11 aa, synthetic construct
EAAAKGSSGGG

SEQ ID NO: 14722 - protein, 11 aa, synthetic construct
GGGGGSEAAAK

SEQ ID NO: 14723 - protein, 11 aa, synthetic construct
EAAAKPAPGGS

SEQ ID NO: 14724 - protein, 11 aa, synthetic construct
EAAAKGSSPAP

SEQ ID NO: 14725 - protein, 7 aa, synthetic construct
GGGGGGG

SEQ ID NO: 14726 - protein, 15 aa, synthetic construct
EAAAKEAAAKEAAAK

SEQ ID NO: 14727 - protein, 9 aa, synthetic construct
GSSPAPGGS

SEQ ID NO: 14728 - protein, 11 aa, synthetic construct
GGGGSSEAAAK

SEQ ID NO: 14729 - protein, 11 aa, synthetic construct
GGSEAAAKGSS

SEQ ID NO: 14730 - protein, 11 aa, synthetic construct
GGSEAAAKGSS

SEQ ID NO: 14731 - protein, 11 aa, synthetic construct
EAAAKPAPGGG

SEQ ID NO: 14732 - protein, 18 aa, synthetic construct
GSSGSSGSSGSSGSSGSS

SEQ ID NO: 14733 - protein, 15 aa, synthetic construct
GGGGSEAAAKGGGGS

SEQ ID NO: 14734 - protein, 9 aa, synthetic construct
GSSPAPGGS

SEQ ID NO: 14735 - protein, 10 aa, synthetic construct
GGGGSGGGGS

SEQ ID NO: 14736 - protein, 9 aa, synthetic construct
GSSGGSPAP

SEQ ID NO: 14737 - protein, 6 aa, synthetic construct
GGSGGS

SEQ ID NO: 14738 - protein, 11 aa, synthetic construct
PAPGSSEAAAK

SEQ ID NO: 14739 - protein, 9 aa, synthetic construct
PAPGGGGSS

SEQ ID NO: 14740 - protein, 9 aa, synthetic construct
GGGGSSGGS

SEQ ID NO: 14741 - protein, 10 aa, synthetic construct
GGGGSGGGGS

SEQ ID NO: 14742 - protein, 20 aa, synthetic construct
GGGGSGGGGSGGGGSGGGGS

SEQ ID NO: 14743 - protein, 11 aa, synthetic construct
GGSGSSEAAAK

SEQ ID NO: 14744 - protein, 9 aa, synthetic construct
GGSGGGGSS

SEQ ID NO: 14745 - protein, 11 aa, synthetic construct
GGSEAAAKPAP

SEQ ID NO: 14746 - protein, 11 aa, synthetic construct
EAAAKGGSPAP

SEQ ID NO: 14747 - protein, 9 aa, synthetic construct
PAPAPAPAP

SEQ ID NO: 14748 - protein, 9 aa, synthetic construct
GSSGGSPAP

SEQ ID NO: 14749 - protein, 9 aa, synthetic construct
GGGGGSPAP

SEQ ID NO: 14750 - protein, 11 aa, synthetic construct
EAAAKGGGPAP

SEQ ID NO: 14751 - protein, 9 aa, synthetic construct
GSSGGSPAP

SEQ ID NO: 14752 - protein, 5 aa, synthetic construct
GGGGG

SEQ ID NO: 14753 - protein, 6 aa, synthetic construct
GGGGGS

SEQ ID NO: 14754 - protein, 15 aa, synthetic construct
EAAAKEAAAKEAAAK

SEQ ID NO: 14755 - protein, 6 aa, synthetic construct
PAPGGG

SEQ ID NO: 14756 - protein, 11 aa, synthetic construct
GSSGGSEAAAK

SEQ ID NO: 14757 - protein, 9 aa, synthetic construct
GGSPAPGGG

SEQ ID NO: 14758 - protein, 18 aa, synthetic construct
GSSGSSGSSGSSGSSGSS

SEQ ID NO: 14759 - protein, 11 aa, synthetic construct
GGSPAPEAAAK

SEQ ID NO: 14760 - protein, 9 aa, synthetic construct
PAPGGGGSS

SEQ ID NO: 14761 - protein, 11 aa, synthetic construct
GGGGSSEAAAK

SEQ ID NO: 14762 - protein, 6 aa, synthetic construct
PAPGGS

SEQ ID NO: 14763 - protein, 15 aa, synthetic construct
GGSGGSGGSGGSGGS

SEQ ID NO: 14764 - protein, 12 aa, synthetic construct
GSAGSAAGSGEF

SEQ ID NO: 14765 - protein, 6 aa, synthetic construct
GSSGGS

SEQ ID NO: 14766 - protein, 9 aa, synthetic construct
GGSGGGGSS

SEQ ID NO: 14767 - protein, 9 aa, synthetic construct
GGSGGGGSS

SEQ ID NO: 14768 - protein, 11 aa, synthetic construct
PAPEAAAKGSS

SEQ ID NO: 14769 - protein, 12 aa, synthetic construct
GSSGSSGSSGSS

SEQ ID NO: 14770 - protein, 13 aa, synthetic construct
PAPAPAPAPAPAP

SEQ ID NO: 14771 - protein, 9 aa, synthetic construct
PAPGSSGGG

SEQ ID NO: 14772 - protein, 9 aa, synthetic construct
GGSGSSPAP

SEQ ID NO: 14773 - protein, 9 aa, synthetic construct
GGSGGGPAP

SEQ ID NO: 14774 - protein, 9 aa, synthetic construct
PAPGGGGGS

SEQ ID NO: 14775 - protein, 11 aa, synthetic construct
EAAAKGSSPAP

SEQ ID NO: 14776 - protein, 9 aa, synthetic construct
GGSGSSPAP

SEQ ID NO: 14777 - protein, 8 aa, synthetic construct
EAAAKGSS

SEQ ID NO: 14778 - protein, 11 aa, synthetic construct
GGGGGSEAAAK

SEQ ID NO: 14779 - protein, 8 aa, synthetic construct
GGGGGGGG

SEQ ID NO: 14780 - protein, 10 aa, synthetic construct
EAAAKEAAAK

SEQ ID NO: 14781 - protein, 11 aa, synthetic construct
GGGEAAAKGGS

SEQ ID NO: 14782 - protein, 11 aa, synthetic construct
EAAAKGGSPAP

SEQ ID NO: 14783 - protein, 8 aa, synthetic construct
GSSEAAAK

SEQ ID NO: 14784 - protein, 11 aa, synthetic construct
PAPGGGEAAAK

SEQ ID NO: 14785 - protein, 6 aa, synthetic construct
GGSPAP

SEQ ID NO: 14786 - protein, 9 aa, synthetic construct
GSSPAPGGG

SEQ ID NO: 14787 - protein, 9 aa, synthetic construct
GGSGSSPAP

SEQ ID NO: 14788 - skipped

SEQ ID NO: 14789 - protein, 9 aa, synthetic construct
GGSGGGGSS

SEQ ID NO: 14790 - protein, 20 aa, synthetic construct
GGGGSGGGGSGGGGSGGGGS

SEQ ID NO: 14791 - protein, 11 aa, synthetic construct
EAAAKGGGPAP

SEQ ID NO: 14792 - protein, 11 aa, synthetic construct
GSSGGGEAAAK

SEQ ID NO: 14793 - protein, 33 aa, synthetic construct; identical to SEQ ID NO: 5006

SEQ ID NO: 14794 - protein, 46 aa, synthetic construct; identical to SEQ ID NO: 5217

SEQ ID NO: 14795 - protein, 10 aa, synthetic construct
EAAAKEAAAK

SEQ ID NO: 14796 - protein, 11 aa, synthetic construct
GSSPAPEAAAK

SEQ ID NO: 14797 - protein, 11 aa, synthetic construct
EAAAKPAPGGS

SEQ ID NO: 14798 - protein, 9 aa, synthetic construct
GSSGGSPAP

SEQ ID NO: 14799 - protein, 11 aa, synthetic construct
GGGPAPEAAAK

SEQ ID NO: 14800 - protein, 11 aa, synthetic construct
GGGEAAAKPAP

SEQ ID NO: 14801 - protein, 11 aa, synthetic construct
GGGGGSEAAAK

SEQ ID NO: 14802 - protein, 9 aa, synthetic construct
GGGPAPGSS

SEQ ID NO: 14803 - protein, 11 aa, synthetic construct
GGSEAAAKPAP

SEQ ID NO: 14804 - protein, 18 aa, synthetic construct
GSSGSSGSSGSSGSSGSS

SEQ ID NO: 14805 - protein, 11 aa, synthetic construct
EAAAKGSSGGS

SEQ ID NO: 14806 - protein, 6 aa, synthetic construct
GGGGGG

SEQ ID NO: 14807 - protein, 9 aa, synthetic construct
GSSPAPGGS

SEQ ID NO: 14808 - protein, 9 aa, synthetic construct
GGSGSSPAP

SEQ ID NO: 14809 - protein, 11 aa, synthetic construct
GGGPAPEAAAK

SEQ ID NO: 14810 - protein, 11 aa, synthetic construct
GGSGGGEAAAK

SEQ ID NO: 14811 - protein, 12 aa, synthetic construct
GSAGSAAGSGEF

SEQ ID NO: 14812 - protein, 11 aa, synthetic construct
GSSGGGEAAAK

SEQ ID NO: 14813 - skipped

SEQ ID NO: 14814 - protein, 9 aa, synthetic construct
PAPGSSGGS

SEQ ID NO: 14815 - protein, 9 aa, synthetic construct
GGGGSSPAP

SEQ ID NO: 14816 - protein, 33 aa, synthetic construct; identical to SEQ ID NO: 5006

SEQ ID NO: 14817 - protein, 7 aa, synthetic construct
GGGGGGG

SEQ ID NO: 14818 - protein, 11 aa, synthetic construct
PAPAPAPAPAP

SEQ ID NO: 14819 - protein, 20 aa, synthetic construct
GGGGSGGGGSGGGGSGGGGS

SEQ ID NO: 14820 - protein, 9 aa, synthetic construct
GGSGGGPAP

SEQ ID NO: 14821 - protein, 6 aa, synthetic construct
GGGGGG

SEQ ID NO: 14822 - protein, 11 aa, synthetic construct
EAAAKPAPGSS

SEQ ID NO: 14823 - protein, 9 aa, synthetic construct
GGGGSSGGS

SEQ ID NO: 14824 - protein, 11 aa, synthetic construct
PAPGSSEAAAK

SEQ ID NO: 14825 - protein, 9 aa, synthetic construct
GGGGSSPAP

SEQ ID NO: 14826 - protein, 9 aa, synthetic construct
PAPGSSGGS

SEQ ID NO: 14827 - protein, 46 aa, synthetic construct; identical to SEQ ID NO: 5217

SEQ ID NO: 14828 - protein, 7 aa, synthetic construct
PAPAPAP

SEQ ID NO: 14829 - protein, 9 aa, synthetic construct
PAPGGGGGS

SEQ ID NO: 14830 - protein, 6 aa, synthetic construct
GGGGSS

SEQ ID NO: 14831 - protein, 20 aa, synthetic construct
EAAAKEAAAKEAAAKEAAAK

SEQ ID NO: 14832 - protein, 15 aa, synthetic construct
GGSGGSGGSGGSGGS

SEQ ID NO: 14833 - protein, 7 aa, synthetic construct
GGGGGGG

SEQ ID NO: 14834 - protein, 11 aa, synthetic construct
PAPGGGEAAAK

SEQ ID NO: 14835 - protein, 6 aa, synthetic construct
PAPGSS

SEQ ID NO: 14836 - protein, 10 aa, synthetic construct
GGGGSGGGGS

SEQ ID NO: 14837 - protein, 9 aa, synthetic construct
GSSGGSGGG

SEQ ID NO: 14838 - protein, 30 aa, synthetic construct; identical to SEQ ID NO: 5112

SEQ ID NO: 14839 - protein, 11 aa, synthetic construct
GSSEAAAKGGG

SEQ ID NO: 14840 - protein, 11 aa, synthetic construct
GGSEAAAKPAP

SEQ ID NO: 14841 - protein, 9 aa, synthetic construct
GSSGGSGGG

SEQ ID NO: 14842 - protein, 11 aa, synthetic construct
EAAAKGGGGSS

SEQ ID NO: 14843 - protein, 6 aa, synthetic construct
GGGGGG

SEQ ID NO: 14844 - protein, 5 aa, synthetic construct
GGGGG

SEQ ID NO: 14845 - protein, 11 aa, synthetic construct
PAPEAAAKGGG

SEQ ID NO: 14846 - protein, 11 aa, synthetic construct
EAAAKGGSPAP

SEQ ID NO: 14847 - protein, 11 aa, synthetic construct
GGGEAAAKPAP

SEQ ID NO: 14848 - protein, 18 aa, synthetic construct
GSSGSSGSSGSSGSSGSS

SEQ ID NO: 14849 - protein, 20 aa, synthetic construct
EAAAKEAAAKEAAAKEAAAK

SEQ ID NO: 14850 - protein, 11 aa, synthetic construct
PAPGSSEAAAK

SEQ ID NO: 14851 - protein, 9 aa, synthetic construct
GSSGSSGSS

SEQ ID NO: 14852 - protein, 9 aa, synthetic construct
GSSGGGPAP

SEQ ID NO: 14853 - protein, 11 aa, synthetic construct
GGGPAPEAAAK

SEQ ID NO: 14854 - protein, 8 aa, synthetic construct
GGGEAAAK

SEQ ID NO: 14855 - protein, 12 aa, synthetic construct
GSSGSSGSSGSS

SEQ ID NO: 14856 - protein, 11 aa, synthetic construct
PAPAPAPAPAP

SEQ ID NO: 14857 - protein, 11 aa, synthetic construct
GGSPAPEAAAK

SEQ ID NO: 14858 - protein, 18 aa, synthetic construct
GSSGSSGSSGSSGSSGSS

SEQ ID NO: 14859 - protein, 25 aa, synthetic construct
EAAAKEAAAKEAAAKEAAAKEAAAK

SEQ ID NO: 14860 - protein, 11 aa, synthetic construct
GGGPAPEAAAK

SEQ ID NO: 14861 - protein, 9 aa, synthetic construct
PAPGGSGGG

SEQ ID NO: 14862 - protein, 9 aa, synthetic construct
PAPGGSGGG

SEQ ID NO: 14863 - protein, 11 aa, synthetic construct
GGGEAAAKGGS

SEQ ID NO: 14864 - protein, 12 aa, synthetic construct
GSAGSAAGSGEF

SEQ ID NO: 14865 - protein, 9 aa, synthetic construct
GSSPAPGGG

SEQ ID NO: 14866 - protein, 18 aa, synthetic construct
GSSGSSGSSGSSGSSGSS

SEQ ID NO: 14867 - protein, 9 aa, synthetic construct
GGSGGGGSS

SEQ ID NO: 14868 - protein, 11 aa, synthetic construct
PAPEAAAKGSS

SEQ ID NO: 14869 - skipped

SEQ ID NO: 14870 - protein, 11 aa, synthetic construct
EAAAKGGGGSS

SEQ ID NO: 14871 - protein, 30 aa, synthetic construct; identical to SEQ ID NO: 5130

SEQ ID NO: 14872 - protein, 30 aa, synthetic construct; identical to SEQ ID NO: 5112

SEQ ID NO: 14873 - protein, 11 aa, synthetic construct
GGGEAAAKGGS

SEQ ID NO: 14874 - protein, 6 aa, synthetic construct
GSSGSS

SEQ ID NO: 14875 - protein, 9 aa, synthetic construct
GSSGGGGGS

SEQ ID NO: 14876 - protein, 11 aa, synthetic construct
GGGGSSEAAAK

SEQ ID NO: 14877 - protein, 11 aa, synthetic construct
EAAAKGSSGGS

SEQ ID NO: 14878 - protein, 11 aa, synthetic construct
GSSEAAAKGGS

SEQ ID NO: 14879 - protein, 11 aa, synthetic construct
EAAAKGSSPAP

SEQ ID NO: 14880 - protein, 11 aa, synthetic construct
EAAAKPAPGSS

SEQ ID NO: 14881 - protein, 9 aa, synthetic construct
PAPGSSGGG

SEQ ID NO: 14882 - protein, 30 aa, synthetic construct; identical to SEQ ID NO: 5112

SEQ ID NO: 14883 - protein, 25 aa, synthetic construct
EAAAKEAAAKEAAAKEAAAKEAAAK

SEQ ID NO: 14884 - protein, 11 aa, synthetic construct
GGGGSSEAAAK

SEQ ID NO: 14885 - protein, 11 aa, synthetic construct
EAAAKGGSPAP

SEQ ID NO: 14886 - protein, 11 aa, synthetic construct
PAPEAAAKGSS

SEQ ID NO: 14887 - protein, 9 aa, synthetic construct
GSSGGGGGS

SEQ ID NO: 14888 - protein, 9 aa, synthetic construct
GGGGSSPAP

SEQ ID NO: 14889 - protein, 11 aa, synthetic construct
EAAAKGGGGSS

SEQ ID NO: 14890 - protein, 9 aa, synthetic construct
PAPAPAPAP

SEQ ID NO: 14891 - protein, 11 aa, synthetic construct
GGSEAAAKGSS

SEQ ID NO: 14892 - protein, 9 aa, synthetic construct
GSSPAPGGG

SEQ ID NO: 14893 - protein, 6 aa, synthetic construct
GGGGGG

SEQ ID NO: 14894 - protein, 9 aa, synthetic construct
GGSGGSGGS

SEQ ID NO: 14895 - protein, 13 aa, synthetic construct
PAPAPAPAPAPAP

SEQ ID NO: 14896 - protein, 6 aa, synthetic construct
GSSPAP

SEQ ID NO: 14897 - protein, 9 aa, synthetic construct
GGGGGSGSS

SEQ ID NO: 14898 - protein, 11 aa, synthetic construct
EAAAKGSSGGS

SEQ ID NO: 14899 - protein, 5 aa, synthetic construct
EAAAK

SEQ ID NO: 14900 - protein, 8 aa, synthetic construct
PAPEAAAK

SEQ ID NO: 14901 - protein, 11 aa, synthetic construct
EAAAKGGSGSS

SEQ ID NO: 14902 - protein, 9 aa, synthetic construct
GGSGGSGGS

SEQ ID NO: 14903 - protein, 11 aa, synthetic construct
GSSGGGEAAAK

SEQ ID NO: 14904 - protein, 33 aa, synthetic construct; identical to SEQ ID NO: 5006

SEQ ID NO: 14905 - protein, 18 aa, synthetic construct
GGSGGSGGSGGSGGSGGS

SEQ ID NO: 14906 - protein, 8 aa, synthetic construct
GGGEAAAK

SEQ ID NO: 14907 - protein, 9 aa, synthetic construct
GGGGGSGSS

SEQ ID NO: 14908 - protein, 9 aa, synthetic construct
GSSPAPGGS

SEQ ID NO: 14909 - protein, 8 aa, synthetic construct
EAAAKGSS

SEQ ID NO: 14910 - protein, 9 aa, synthetic construct
GSSGGSGGG

SEQ ID NO: 14911 - protein, 9 aa, synthetic construct
GGSGGGGSS

SEQ ID NO: 14912 - protein, 9 aa, synthetic construct
GGSPAPGSS

SEQ ID NO: 14913 - protein, 18 aa, synthetic construct
GGSGGSGGSGGSGGSGGS

SEQ ID NO: 14914 - protein, 11 aa, synthetic construct
GSSEAAAKGGG

SEQ ID NO: 14915 - protein, 9 aa, synthetic construct
GGSGGSGGS

SEQ ID NO: 14916 - protein, 18 aa, synthetic construct
GSSGSSGSSGSSGSSGSS

SEQ ID NO: 14917 - protein, 15 aa, synthetic construct
GSSGSSGSSGSSGSS

SEQ ID NO: 14918 - protein, 8 aa, synthetic construct
PAPEAAAK

SEQ ID NO: 14919 - protein, 15 aa, synthetic construct
GSSGSSGSSGSSGSS

SEQ ID NO: 14920 - protein, 15 aa, synthetic construct
EAAAKGGGGSEAAAK

SEQ ID NO: 14921 - protein, 11 aa, synthetic construct
GGSPAPEAAAK

SEQ ID NO: 14922 - protein, 6 aa, synthetic construct
GSSGSS

SEQ ID NO: 14923 - skipped

SEQ ID NO: 14924 - protein, 15 aa, synthetic construct
GGGGSGGGGSGGGGS

SEQ ID NO: 14925 - protein, 30 aa, synthetic construct; identical to SEQ ID NO: 5130

SEQ ID NO: 14926 - protein, 9 aa, synthetic construct
GGSGSSPAP

SEQ ID NO: 14927 - protein, 8 aa, synthetic construct
GGGGGGGG

SEQ ID NO: 14928 - protein, 11 aa, synthetic construct
PAPGSSEAAAK

SEQ ID NO: 14929 - protein, 9 aa, synthetic construct
GGGGSSPAP

SEQ ID NO: 14930 - protein, 9 aa, synthetic construct
GSSGGSPAP

SEQ ID NO: 14931 - protein, 9 aa, synthetic construct
GSSGGGGGS

SEQ ID NO: 14932 - protein, 25 aa, synthetic construct
EAAAKEAAAKEAAAKEAAAKEAAAK

SEQ ID NO: 14933 - protein, 9 aa, synthetic construct
GSSGGGGGS

SEQ ID NO: 14934 - protein, 15 aa, synthetic construct
GGGGSEAAAKGGGGS

SEQ ID NO: 14935 - protein, 11 aa, synthetic construct
GGGEAAAKPAP

SEQ ID NO: 14936 - protein, 11 aa, synthetic construct
PAPGGGEAAAK

SEQ ID NO: 14937 - protein, 11 aa, synthetic construct
GGSGGGEAAAK

SEQ ID NO: 14938 - protein, 6 aa, synthetic construct
GSSGGG

SEQ ID NO: 14939 - protein, 11 aa, synthetic construct
EAAAKGSSGGS

SEQ ID NO: 14940 - protein, 5 aa, synthetic construct
GGGGG

SEQ ID NO: 14941 - protein, 6 aa, synthetic construct
GGGPAP

SEQ ID NO: 14942 - protein, 11 aa, synthetic construct
GSSGGSEAAAK

SEQ ID NO: 14943 - protein, 33 aa, synthetic construct; identical to SEQ ID NO: 5006

SEQ ID NO: 14944 - protein, 11 aa, synthetic construct
GSSGGGEAAAK

SEQ ID NO: 14945 - protein, 15 aa, synthetic construct
GSSGSSGSSGSSGSS

SEQ ID NO: 14946 - protein, 11 aa, synthetic construct
GGSEAAAKPAP

SEQ ID NO: 14947 - protein, 10 aa, synthetic construct
GGGGSGGGGS

SEQ ID NO: 14948 - protein, 11 aa, synthetic construct
GSSEAAAKPAP

SEQ ID NO: 14949 - protein, 15 aa, synthetic construct
GGGGSEAAAKGGGGS

SEQ ID NO: 14950 - protein, 11 aa, synthetic construct
PAPGSSEAAAK

SEQ ID NO: 14951 - protein, 11 aa, synthetic construct
EAAAKGGSGGG

SEQ ID NO: 14952 - protein, 9 aa, synthetic construct
GGGPAPGGS

SEQ ID NO: 14953 - protein, 11 aa, synthetic construct
GSSEAAAKGGS

SEQ ID NO: 14954 - protein, 11 aa, synthetic construct
EAAAKGGSGGG

SEQ ID NO: 14955 - protein, 9 aa, synthetic construct
GSSGGSPAP

SEQ ID NO: 14956 - protein, 5 aa, synthetic construct
PAPAP

SEQ ID NO: 14957 - protein, 9 aa, synthetic construct
PAPGGSGSS

SEQ ID NO: 14958 - protein, 11 aa, synthetic construct
EAAAKGGGGGS

SEQ ID NO: 14959 - protein, 11 aa, synthetic construct
PAPEAAAKGGS

SEQ ID NO: 14960 - protein, 11 aa, synthetic construct
GSSEAAAKPAP

SEQ ID NO: 14961 - protein, 6 aa, synthetic construct
GGSGGS

SEQ ID NO: 14962 - protein, 11 aa, synthetic construct
GSSEAAAKGGG

SEQ ID NO: 14963 - protein, 5 aa, synthetic construct
EAAAK

SEQ ID NO: 14964 - protein, 6 aa, synthetic construct
GSSPAP

SEQ ID NO: 14965 - protein, 11 aa, synthetic construct
EAAAKPAPGGG

SEQ ID NO: 14966 - protein, 15 aa, synthetic construct
GGGGSEAAAKGGGGS

SEQ ID NO: 14967 - protein, 11 aa, synthetic construct
EAAAKGSSGGS

SEQ ID NO: 14968 - protein, 12 aa, synthetic construct
GSAGSAAGSGEF

SEQ ID NO: 14969 - protein, 11 aa, synthetic construct
PAPEAAAKGGS

SEQ ID NO: 14970 - protein, 30 aa, synthetic construct; identical to SEQ ID NO: 5130

SEQ ID NO: 14971 - skipped

SEQ ID NO: 14972 - protein, 11 aa, synthetic construct
GGSEAAAKPAP

SEQ ID NO: 14973 - protein, 11 aa, synthetic construct
EAAAKGSSGGG

SEQ ID NO: 14974 - protein, 11 aa, synthetic construct
GGSEAAAKGGG

SEQ ID NO: 14975 - protein, 6 aa, synthetic construct
GGSGGS

SEQ ID NO: 14976 - protein, 11 aa, synthetic construct
GSSEAAAKGGS

SEQ ID NO: 14977 - protein, 11 aa, synthetic construct
PAPAPAPAPAP

SEQ ID NO: 14978 - protein, 11 aa, synthetic construct
GGSEAAAKGGG

SEQ ID NO: 14979 - protein, 9 aa, synthetic construct
PAPAPAPAP

SEQ ID NO: 14980 - protein, 25 aa, synthetic construct
GGGGSGGGGSGGGGSGGGGSGGGGS

SEQ ID NO: 14981 - protein, 11 aa, synthetic construct
PAPGGSEAAAK

SEQ ID NO: 14982 - protein, 9 aa, synthetic construct
GGSGGGPAP

SEQ ID NO: 14983 - protein, 18 aa, synthetic construct
GSSGSSGSSGSSGSSGSS

SEQ ID NO: 14984 - protein, 11 aa, synthetic construct
GGSEAAAKPAP

SEQ ID NO: 14985 - protein, 11 aa, synthetic construct
GGGEAAAKGSS

SEQ ID NO: 14986 - protein, 9 aa, synthetic construct
GGGPAPGGS

SEQ ID NO: 14987 - protein, 6 aa, synthetic construct
PAPGGG

SEQ ID NO: 14988 - protein, 11 aa, synthetic construct
GGSEAAAKGSS

SEQ ID NO: 14989 - protein, 11 aa, synthetic construct
GGGEAAAKGSS

SEQ ID NO: 14990 - protein, 11 aa, synthetic construct
GGGEAAAKGSS

SEQ ID NO: 14991 - protein, 20 aa, synthetic construct
EAAAKEAAAKEAAAKEAAAK

SEQ ID NO: 14992 - protein, 11 aa, synthetic construct
EAAAKGGGPAP

SEQ ID NO: 14993 - protein, 11 aa, synthetic construct
EAAAKGGGGSS

SEQ ID NO: 14994 - protein, 25 aa, synthetic construct
EAAAKEAAAKEAAAKEAAAKEAAAK

SEQ ID NO: 14995 - protein, 9 aa, synthetic construct
GSSGGGGGS

SEQ ID NO: 14996 - protein, 7 aa, synthetic construct
PAPAPAP

SEQ ID NO: 14997 - protein, 12 aa, synthetic construct
GGSGGSGGSGGS

SEQ ID NO: 14998 - protein, 8 aa, synthetic construct
GGGEAAAK

SEQ ID NO: 14999 - protein, 6 aa, synthetic construct
GGGGGS

SEQ ID NO: 15000 - protein, 6 aa, synthetic construct
GGSGGS

SEQ ID NO: 15001 - protein, 8 aa, synthetic construct
EAAAKGGS

SEQ ID NO: 15002 - protein, 6 aa, synthetic construct
GGGGSS

SEQ ID NO: 15003 - protein, 5 aa, synthetic construct
PAPAP

SEQ ID NO: 15004 - protein, 6 aa, synthetic construct
PAPGGG

SEQ ID NO: 15005 - protein, 11 aa, synthetic construct
EAAAKGGGGSS

SEQ ID NO: 15006 - protein, 11 aa, synthetic construct
PAPAPAPAPAP

SEQ ID NO: 15007 - protein, 6 aa, synthetic construct
GGGPAP

SEQ ID NO: 15008 - protein, 9 aa, synthetic construct
GSSGGSGGG

SEQ ID NO: 15009 - protein, 11 aa, synthetic construct
EAAAKGGGPAP

SEQ ID NO: 15010 - protein, 12 aa, synthetic construct
GSSGSSGSSGSS

SEQ ID NO: 15011 - protein, 10 aa, synthetic construct
GGGGSGGGGS

SEQ ID NO: 15012 - protein, 9 aa, synthetic construct
GSSGGSGGG

SEQ ID NO: 15013 - protein, 11 aa, synthetic construct
GGGEAAAKPAP

SEQ ID NO: 15014 - protein, 8 aa, synthetic construct
PAPEAAAK

SEQ ID NO: 15015 - protein, 12 aa, synthetic construct
GSSGSSGSSGSS

SEQ ID NO: 15016 - protein, 11 aa, synthetic construct
GSSEAAAKPAP

SEQ ID NO: 15017 - protein, 11 aa, synthetic construct
PAPEAAAKGGG

SEQ ID NO: 15018 - protein, 11 aa, synthetic construct
GGSEAAAKGSS

SEQ ID NO: 15019 - protein, 11 aa, synthetic construct
EAAAKPAPGGS

SEQ ID NO: 15020 - protein, 11 aa, synthetic construct
GSSGGSEAAAK

SEQ ID NO: 15021 - protein, 30 aa, synthetic construct; identical to SEQ ID NO: 5112

SEQ ID NO: 15022 - protein, 11 aa, synthetic construct
EAAAKGGGGSS

SEQ ID NO: 15023 - protein, 9 aa, synthetic construct
GGGGGSGSS

SEQ ID NO: 15024 - protein, 5 aa, synthetic construct
PAPAP

SEQ ID NO: 15025 - protein, 9 aa, synthetic construct
GGGGGSPAP

SEQ ID NO: 15026 - protein, 6 aa, synthetic construct
GGGPAP

SEQ ID NO: 15027 - protein, 15 aa, synthetic construct
EAAAKGGGGSEAAAK

SEQ ID NO: 15028 - protein, 11 aa, synthetic construct
GGSEAAAKGGG

SEQ ID NO: 15029 - protein, 9 aa, synthetic construct
GSSPAPGGS

SEQ ID NO: 15030 - protein, 7 aa, synthetic construct
GGGGGGG

SEQ ID NO: 15031 - protein, 8 aa, synthetic construct
EAAAKGSS

SEQ ID NO: 15032 - protein, 15 aa, synthetic construct
EAAAKGGGGSEAAAK

SEQ ID NO: 15033 - protein, 15 aa, synthetic construct
GGGGSEAAAKGGGGS

SEQ ID NO: 15034 - protein, 11 aa, synthetic construct
EAAAKGGGGSS

SEQ ID NO: 15035 - protein, 11 aa, synthetic construct
GGGEAAAKGGS

SEQ ID NO: 15036 - protein, 11 aa, synthetic construct
PAPEAAAKGGG

SEQ ID NO: 15037 - protein, 9 aa, synthetic construct
GGGGSSGGS

SEQ ID NO: 15038 - protein, 6 aa, synthetic construct
GGSGSS

SEQ ID NO: 15039 - protein, 13 aa, synthetic construct
PAPAPAPAPAPAP

SEQ ID NO: 15040 - protein, 8 aa, synthetic construct
EAAAKGGG

SEQ ID NO: 15041 - protein, 13 aa, synthetic construct
PAPAPAPAPAPAP

SEQ ID NO: 15042 - protein, 15 aa, synthetic construct
GSSGSSGSSGSSGSS

SEQ ID NO: 15043 - protein, 6 aa, synthetic construct
GGGGSS

SEQ ID NO: 15044 - protein, 11 aa, synthetic construct
PAPGGGEAAAK

SEQ ID NO: 15045 - protein, 11 aa, synthetic construct
GGSGGGEAAAK

SEQ ID NO: 15046 - protein, 11 aa, synthetic construct
PAPAPAPAPAP

SEQ ID NO: 15047 - protein, 11 aa, synthetic construct
GGGEAAAKGGS

SEQ ID NO: 15048 - protein, 11 aa, synthetic construct
GGGEAAAKGSS

SEQ ID NO: 15049 - protein, 11 aa, synthetic construct
GSSPAPEAAAK

SEQ ID NO: 15050 - protein, 25 aa, synthetic construct
EAAAKEAAAKEAAAKEAAAKEAAAK

SEQ ID NO: 15051 - protein, 6 aa, synthetic construct
PAPGGG

SEQ ID NO: 15052 - protein, 11 aa, synthetic construct
GSSEAAAKGGG

SEQ ID NO: 15053 - protein, 11 aa, synthetic construct
GGGGSSEAAAK

SEQ ID NO: 15054 - protein, 9 aa, synthetic construct
PAPGSSGGS

SEQ ID NO: 15055 - protein, 18 aa, synthetic construct
GSSGSSGSSGSSGSSGSS

SEQ ID NO: 15056 - protein, 11 aa, synthetic construct
EAAAKGSSGGG

SEQ ID NO: 15057 - protein, 9 aa, synthetic construct
PAPGGGGSS

SEQ ID NO: 15058 - protein, 6 aa, synthetic construct
GGSPAP

SEQ ID NO: 15059 - protein, 15 aa, synthetic construct
GGSGGSGGSGGSGGS

SEQ ID NO: 15060 - protein, 9 aa, synthetic construct
PAPAPAPAP

SEQ ID NO: 15061 - protein, 5 aa, synthetic construct
GGGGG

SEQ ID NO: 15062 - protein, 12 aa, synthetic construct
GGSGGSGGSGGS

SEQ ID NO: 15063 - protein, 15 aa, synthetic construct
GSSGSSGSSGSSGSS

SEQ ID NO: 15064 - protein, 11 aa, synthetic construct
PAPGGSEAAAK

SEQ ID NO: 15065 - protein, 9 aa, synthetic construct
PAPAPAPAP

SEQ ID NO: 15066 - protein, 9 aa, synthetic construct
PAPGGGGSS

SEQ ID NO: 15067 - protein, 6 aa, synthetic construct
GGSGSS

SEQ ID NO: 15068 - protein, 20 aa, synthetic construct
EAAAKEAAAKEAAAKEAAAK

SEQ ID NO: 15069 - protein, 11 aa, synthetic construct
EAAAKGGSGGG

SEQ ID NO: 15070 - protein, 9 aa, synthetic construct
PAPGGGGSS

SEQ ID NO: 15071 - protein, 11 aa, synthetic construct
EAAAKGGGGGS

SEQ ID NO: 15072 - protein, 6 aa, synthetic construct
GGGGGS

SEQ ID NO: 15073 - protein, 11 aa, synthetic construct
GGGEAAAKGGS

SEQ ID NO: 15074 - protein, 11 aa, synthetic construct
EAAAKPAPGGG

SEQ ID NO: 15075 - protein, 9 aa, synthetic construct
GGSGGGPAP

SEQ ID NO: 15076 - protein, 11 aa, synthetic construct
GSSEAAAKPAP

SEQ ID NO: 15077 - protein, 13 aa, synthetic construct
PAPAPAPAPAPAP

SEQ ID NO: 15078 - protein, 9 aa, synthetic construct
GGSPAPGGG

SEQ ID NO: 15079 - protein, 11 aa, synthetic construct
GGSGGGEAAAK

SEQ ID NO: 15080 - protein, 5 aa, synthetic construct
PAPAP

SEQ ID NO: 15081 - protein, 8 aa, synthetic construct
GSSEAAAK

SEQ ID NO: 15082 - protein, 15 aa, synthetic construct
GGGGSGGGGSGGGGS

SEQ ID NO: 15083 - protein, 9 aa, synthetic construct
GSSGSSGSS

SEQ ID NO: 15084 - protein, 11 aa, synthetic construct
EAAAKGGSGGG

SEQ ID NO: 15085 - protein, 6 aa, synthetic construct
GSSPAP

SEQ ID NO: 15086 - protein, 8 aa, synthetic construct
GGGEAAAK

SEQ ID NO: 15087 - protein, 46 aa, synthetic construct; identical to SEQ ID NO: 5217

SEQ ID NO: 15088 - protein, 6 aa, synthetic construct
PAPGGS

SEQ ID NO: 15089 - protein, 9 aa, synthetic construct
PAPGSSGGS

SEQ ID NO: 15090 - protein, 8 aa, synthetic construct
PAPEAAAK

SEQ ID NO: 15091 - protein, 5 aa, synthetic construct
PAPAP

SEQ ID NO: 15092 - protein, 8 aa, synthetic construct
EAAAKGGS

SEQ ID NO: 15093 - protein, 15 aa, synthetic construct
GGGGSEAAAKGGGGS

SEQ ID NO: 15094 - protein, 11 aa, synthetic construct
EAAAKGSSGGS

SEQ ID NO: 15095 - protein, 9 aa, synthetic construct
PAPGGSGSS

SEQ ID NO: 15096 - protein, 11 aa, synthetic construct
PAPGGSEAAAK

SEQ ID NO: 15097 - protein, 11 aa, synthetic construct
PAPGSSEAAAK

SEQ ID NO: 15098 - protein, 9 aa, synthetic construct
PAPGSSGGG

SEQ ID NO: 15099 - protein, 11 aa, synthetic construct
GSSGGGEAAAK

SEQ ID NO: 15100 - protein, 6 aa, synthetic construct
GGGGGG

SEQ ID NO: 15101 - protein, 11 aa, synthetic construct
PAPEAAAKGGG

SEQ ID NO: 15102 - protein, 11 aa, synthetic construct
GGGEAAAKGGS

SEQ ID NO: 15103 - protein, 11 aa, synthetic construct
PAPAPAPAPAP

SEQ ID NO: 15104 - protein, 18 aa, synthetic construct
GSSGSSGSSGSSGSSGSS

SEQ ID NO: 15105 - protein, 11 aa, synthetic construct
EAAAKGGGPAP

SEQ ID NO: 15106 - protein, 11 aa, synthetic construct
PAPAPAPAPAP

SEQ ID NO: 15107 - protein, 11 aa, synthetic construct
PAPGGSEAAAK

SEQ ID NO: 15108 - protein, 9 aa, synthetic construct
GSSGGGPAP

SEQ ID NO: 15109 - protein, 9 aa, synthetic construct
GGGGGSPAP

SEQ ID NO: 15110 - protein, 9 aa, synthetic construct
GSSGGSGGG

SEQ ID NO: 15111 - protein, 5 aa, synthetic construct
PAPAP

SEQ ID NO: 15112 - protein, 9 aa, synthetic construct
GSSGGGPAP

SEQ ID NO: 15113 - protein, 6 aa, synthetic construct
GGSGSS

SEQ ID NO: 15114 - protein, 11 aa, synthetic construct
GGSPAPEAAAK

SEQ ID NO: 15115 - protein, 11 aa, synthetic construct
EAAAKGGSGGG

SEQ ID NO: 15116 - protein, 11 aa, synthetic construct
GGGGSSEAAAK

SEQ ID NO: 15117 - protein, 9 aa, synthetic construct
GGGGGSGSS

SEQ ID NO: 15118 - protein, 9 aa, synthetic construct
GGGGSSGGS

SEQ ID NO: 15119 - protein, 15 aa, synthetic construct
EAAAKGGGGSEAAAK

SEQ ID NO: 15120 - protein, 11 aa, synthetic construct
PAPGGGEAAAK

SEQ ID NO: 15121 - protein, 11 aa, synthetic construct
PAPEAAAKGGG

SEQ ID NO: 15122 - protein, 46 aa, synthetic construct; identical to SEQ ID NO: 5217

SEQ ID NO: 15123 - protein, 11 aa, synthetic construct
GSSGGSEAAAK

SEQ ID NO: 15124 - protein, 6 aa, synthetic construct
GGSPAP

SEQ ID NO: 15125 - protein, 8 aa, synthetic construct
GSSEAAAK

SEQ ID NO: 15126 - protein, 8 aa, synthetic construct
GSSEAAAK

SEQ ID NO: 15127 - protein, 11 aa, synthetic construct
EAAAKGSSGGS

SEQ ID NO: 15128 - protein, 11 aa, synthetic construct
GGGEAAAKPAP

SEQ ID NO: 15129 - protein, 11 aa, synthetic construct
EAAAKGGSPAP

SEQ ID NO: 15130 - protein, 11 aa, synthetic construct
GSSEAAAKPAP

SEQ ID NO: 15131 - protein, 9 aa, synthetic construct
GSSGSSGSS

SEQ ID NO: 15132 - protein, 20 aa, synthetic construct
EAAAKEAAAKEAAAKEAAAK

SEQ ID NO: 15133 - protein, 5 aa, synthetic construct
EAAAK

SEQ ID NO: 15134 - protein, 6 aa, synthetic construct
PAPGSS

SEQ ID NO: 15135 - protein, 6 aa, synthetic construct
PAPGGS

SEQ ID NO: 15136 - protein, 6 aa, synthetic construct
GGSGGS

SEQ ID NO: 15137 - protein, 33 aa, synthetic construct; identical to SEQ ID NO: 5006

SEQ ID NO: 15138 - protein, 11 aa, synthetic construct
GGSGGGEAAAK

SEQ ID NO: 15139 - protein, 9 aa, synthetic construct
PAPGSSGGG

SEQ ID NO: 15140 - protein, 6 aa, synthetic construct
GGSGGS

SEQ ID NO: 15141 - protein, 6 aa, synthetic construct
GSSGSS

SEQ ID NO: 15142 - protein, 11 aa, synthetic construct
PAPGGSEAAAK

SEQ ID NO: 15143 - protein, 12 aa, synthetic construct
GSAGSAAGSGEF

SEQ ID NO: 15144 - protein, 6 aa, synthetic construct
PAPGGG

SEQ ID NO: 15145 - protein, 11 aa, synthetic construct
EAAAKGGSGSS

SEQ ID NO: 15146 - protein, 11 aa, synthetic construct
GSSGGGEAAAK

SEQ ID NO: 15147 - protein, 9 aa, synthetic construct
GGSGGGPAP

SEQ ID NO: 15148 - protein, 13 aa, synthetic construct
PAPAPAPAPAPAP

SEQ ID NO: 15149 - protein, 16 aa, synthetic construct
SGSETPGTSESATPES

SEQ ID NO: 15150 - protein, 9 aa, synthetic construct
GGSGGSGGS

SEQ ID NO: 15151 - protein, 6 aa, synthetic construct
GGGGSS

SEQ ID NO: 15152 - protein, 11 aa, synthetic construct
GGGGGSEAAAK

SEQ ID NO: 15153 - protein, 16 aa, synthetic construct
SGSETPGTSESATPES

SEQ ID NO: 15154 - protein, 7 aa, synthetic construct
PAPAPAP

SEQ ID NO: 15155 - protein, 11 aa, synthetic construct
PAPEAAAKGSS

SEQ ID NO: 15156 - protein, 15 aa, synthetic construct
GSSGSSGSSGSSGSS

SEQ ID NO: 15157 - protein, 9 aa, synthetic construct
GGGPAPGSS

SEQ ID NO: 15158 - protein, 9 aa, synthetic construct
GGSGGGGSS

SEQ ID NO: 15159 - protein, 16 aa, synthetic construct
SGSETPGTSESATPES

SEQ ID NO: 15160 - protein, 11 aa, synthetic construct
EAAAKGSSGGS

SEQ ID NO: 15161 - protein, 11 aa, synthetic construct
GSSPAPEAAAK

SEQ ID NO: 15162 - protein, 11 aa, synthetic construct
GSSPAPEAAAK

SEQ ID NO: 15163 - protein, 9 aa, synthetic construct
GGGGSSPAP

SEQ ID NO: 15164 - protein, 11 aa, synthetic construct
PAPGGGEAAAK

SEQ ID NO: 15165 - protein, 11 aa, synthetic construct
PAPEAAAKGGS

SEQ ID NO: 15166 - protein, 18 aa, synthetic construct
GSSGSSGSSGSSGSSGSS

SEQ ID NO: 15167 - protein, 9 aa, synthetic construct
GGSPAPGSS

SEQ ID NO: 15168 - protein, 9 aa, synthetic construct
GGGPAPGGS

SEQ ID NO: 15169 - protein, 9 aa, synthetic construct
GGGPAPGSS

SEQ ID NO: 15170 - protein, 8 aa, synthetic construct
EAAAKPAP

SEQ ID NO: 15171 - protein, 15 aa, synthetic construct
EAAAKEAAAKEAAAK

SEQ ID NO: 15172 - protein, 11 aa, synthetic construct
GSSGGSEAAAK

SEQ ID NO: 15173 - protein, 9 aa, synthetic construct
PAPGGGGGS

SEQ ID NO: 15174 - protein, 8 aa, synthetic construct
GGGEAAAK

SEQ ID NO: 15175 - protein, 11 aa, synthetic construct
EAAAKGGGPAP

SEQ ID NO: 15176 - protein, 9 aa, synthetic construct
GGSGSSGGG

SEQ ID NO: 15177 - protein, 11 aa, synthetic construct
PAPEAAAKGSS

SEQ ID NO: 15178 - protein, 9 aa, synthetic construct
PAPGGGGGS

SEQ ID NO: 15179 - protein, 11 aa, synthetic construct
EAAAKGGGGGS

SEQ ID NO: 15180 - protein, 6 aa, synthetic construct
GGGGGS

SEQ ID NO: 15181 - protein, 25 aa, synthetic construct
GGGGSGGGGSGGGGSGGGGSGGGGS

SEQ ID NO: 15182 - protein, 11 aa, synthetic construct
EAAAKGGSPAP

SEQ ID NO: 15183 - protein, 9 aa, synthetic construct
GGGGSSPAP

SEQ ID NO: 15184 - protein, 9 aa, synthetic construct
GGGGSSGGS

SEQ ID NO: 15185 - protein, 9 aa, synthetic construct
PAPGSSGGS

SEQ ID NO: 15186 - protein, 6 aa, synthetic construct
GGGGGS

SEQ ID NO: 15187 - protein, 9 aa, synthetic construct
GGSGSSGGG

SEQ ID NO: 15188 - protein, 11 aa, synthetic construct
GSSGGSEAAAK

SEQ ID NO: 15189 - protein, 20 aa, synthetic construct
EAAAKEAAAKEAAAKEAAAK

SEQ ID NO: 15190 - protein, 11 aa, synthetic construct
GGSEAAAKGGG

SEQ ID NO: 15191 - protein, 33 aa, synthetic construct; identical to SEQ ID NO: 5006

SEQ ID NO: 15192 - protein, 11 aa, synthetic construct
GSSEAAAKGGS

SEQ ID NO: 15193 - protein, 30 aa, synthetic construct; identical to SEQ ID NO: 5112

SEQ ID NO: 15194 - protein, 8 aa, synthetic construct
GGGEAAAK

SEQ ID NO: 15195 - protein, 9 aa, synthetic construct
PAPAPAPAP

SEQ ID NO: 15196 - protein, 9 aa, synthetic construct
PAPGSSGGG

SEQ ID NO: 15197 - protein, 15 aa, synthetic construct
GSSGSSGSSGSSGSS

SEQ ID NO: 15198 - protein, 6 aa, synthetic construct
GGSPAP

SEQ ID NO: 15199 - protein, 30 aa, synthetic construct; identical to SEQ ID NO: 5112

SEQ ID NO: 15200 - protein, 8 aa, synthetic construct
PAPEAAAK

SEQ ID NO: 15201 - protein, 9 aa, synthetic construct
PAPGSSGGG

SEQ ID NO: 15202 - protein, 11 aa, synthetic construct
GGGGGSEAAAK

SEQ ID NO: 15203 - protein, 11 aa, synthetic construct
PAPAPAPAPAP

SEQ ID NO: 15204 - protein, 11 aa, synthetic construct
EAAAKGGSGSS

SEQ ID NO: 15205 - protein, 20 aa, synthetic construct
EAAAKEAAAKEAAAKEAAAK

SEQ ID NO: 15206 - protein, 9 aa, synthetic construct
PAPAPAPAP

SEQ ID NO: 15207 - protein, 9 aa, synthetic construct
GGGPAPGSS

SEQ ID NO: 15208 - protein, 11 aa, synthetic construct
PAPEAAAKGSS

SEQ ID NO: 15209 - protein, 9 aa, synthetic construct
GGSPAPGGG

SEQ ID NO: 15210 - protein, 20 aa, synthetic construct
GGGGSGGGGSGGGGSGGGGS

SEQ ID NO: 15211 - protein, 8 aa, synthetic construct
EAAAKGGS

SEQ ID NO: 15212 - protein, 9 aa, synthetic construct
PAPGSSGGS

SEQ ID NO: 15213 - protein, 10 aa, synthetic construct
GGGGSGGGGS

SEQ ID NO: 15214 - protein, 6 aa, synthetic construct
GGSGGS

SEQ ID NO: 15215 - protein, 15 aa, synthetic construct
EAAAKGGGGSEAAAK

SEQ ID NO: 15216 - protein, 20 aa, synthetic construct
EAAAKEAAAKEAAAKEAAAK

SEQ ID NO: 15217 - protein, 11 aa, synthetic construct
PAPGGGEAAAK

SEQ ID NO: 15218 - protein, 6 aa, synthetic construct
GSSGSS

SEQ ID NO: 15219 - protein, 11 aa, synthetic construct
EAAAKGGGGGS

SEQ ID NO: 15220 - protein, 11 aa, synthetic construct
GSSPAPEAAAK

SEQ ID NO: 15221 - protein, 8 aa, synthetic construct
GGGEAAAK

SEQ ID NO: 15222 - protein, 11 aa, synthetic construct
PAPEAAAKGSS

SEQ ID NO: 15223 - protein, 11 aa, synthetic construct
GGGGSSEAAAK

SEQ ID NO: 15224 - protein, 9 aa, synthetic construct
PAPGSSGGS

SEQ ID NO: 15225 - protein, 11 aa, synthetic construct
EAAAKGGGGGS

SEQ ID NO: 15226 - protein, 20 aa, synthetic construct
GGGGSGGGGSGGGGSGGGGS

SEQ ID NO: 15227 - protein, 11 aa, synthetic construct
EAAAKGGGGSS

SEQ ID NO: 15228 - protein, 11 aa, synthetic construct
GGGEAAAKGGS

SEQ ID NO: 15229 - protein, 9 aa, synthetic construct
GGGGGSPAP

SEQ ID NO: 15230 - protein, 11 aa, synthetic construct
GGSGGGEAAAK

SEQ ID NO: 15231 - protein, 9 aa, synthetic construct
PAPGGGGGS

SEQ ID NO: 15232 - protein, 15 aa, synthetic construct
EAAAKGGGGSEAAAK

SEQ ID NO: 15233 - protein, 11 aa, synthetic construct
PAPEAAAKGSS

SEQ ID NO: 15234 - protein, 11 aa, synthetic construct
GGSEAAAKGGG

SEQ ID NO: 15235 - protein, 15 aa, synthetic construct
GGSGGSGGSGGSGGS

SEQ ID NO: 15236 - protein, 15 aa, synthetic construct
GGSGGSGGSGGSGGS

SEQ ID NO: 15237 - protein, 6 aa, synthetic construct
GGGGGG

SEQ ID NO: 15238 - protein, 9 aa, synthetic construct
GGGGGSGSS

SEQ ID NO: 15239 - protein, 11 aa, synthetic construct
GGSEAAAKPAP

SEQ ID NO: 15240 - protein, 9 aa, synthetic construct
GGGPAPGSS

SEQ ID NO: 15241 - protein, 6 aa, synthetic construct
GGGGGS

SEQ ID NO: 15242 - protein, 11 aa, synthetic construct
GGSPAPEAAAK

SEQ ID NO: 15243 - protein, 11 aa, synthetic construct
PAPEAAAKGGS

SEQ ID NO: 15244 - protein, 11 aa, synthetic construct
EAAAKGGSGSS

SEQ ID NO: 15245 - protein, 11 aa, synthetic construct
GGGPAPEAAAK

SEQ ID NO: 15246 - protein, 9 aa, synthetic construct
PAPGGGGSS

SEQ ID NO: 15247 - protein, 9 aa, synthetic construct
GSSPAPGGG

SEQ ID NO: 15248 - protein, 9 aa, synthetic construct
GGGGSSGGS

SEQ ID NO: 15249 - protein, 11 aa, synthetic construct
EAAAKGGGGGS

SEQ ID NO: 15250 - protein, 11 aa, synthetic construct
GGSEAAAKGSS

SEQ ID NO: 15251 - protein, 6 aa, synthetic construct
GSSGGG

SEQ ID NO: 15252 - protein, 12 aa, synthetic construct
GGSGGSGGSGGS

SEQ ID NO: 15253 - protein, 8 aa, synthetic construct
EAAAKPAP

SEQ ID NO: 15254 - protein, 9 aa, synthetic construct
GGGGSSGGS

SEQ ID NO: 15255 - protein, 6 aa, synthetic construct
GGSGGS

SEQ ID NO: 15256 - protein, 11 aa, synthetic construct
EAAAKGGGGGS

SEQ ID NO: 15257 - protein, 30 aa, synthetic construct; identical to SEQ ID NO: 5112

SEQ ID NO: 15258 - protein, 9 aa, synthetic construct
GGSGGSGGS

SEQ ID NO: 15259 - protein, 11 aa, synthetic construct
GGGGGSEAAAK

SEQ ID NO: 15260 - protein, 9 aa, synthetic construct
GGSGSSPAP

SEQ ID NO: 15261 - protein, 15 aa, synthetic construct
EAAAKEAAAKEAAAK

SEQ ID NO: 15262 - protein, 11 aa, synthetic construct
PAPEAAAKGGS

SEQ ID NO: 15263 - protein, 11 aa, synthetic construct
GGSGSSEAAAK

SEQ ID NO: 15264 - protein, 9 aa, synthetic construct
GGGGGSGSS

SEQ ID NO: 15265 - protein, 9 aa, synthetic construct
GGGPAPGGS

SEQ ID NO: 15266 - protein, 16 aa, synthetic construct
SGSETPGTSESATPES

SEQ ID NO: 15267 - protein, 9 aa, synthetic construct
GSSPAPGGS

SEQ ID NO: 15268 - protein, 15 aa, synthetic construct
GSSGSSGSSGSSGSS

SEQ ID NO: 15269 - protein, 11 aa, synthetic construct
EAAAKGGGPAP

SEQ ID NO: 15270 - protein, 6 aa, synthetic construct
GSSGGG

SEQ ID NO: 15271 - protein, 11 aa, synthetic construct
GGGEAAAKPAP

SEQ ID NO: 15272 - protein, 9 aa, synthetic construct
PAPGGSGGG

SEQ ID NO: 15273 - protein, 9 aa, synthetic construct
GSSGGSGGG

SEQ ID NO: 15274 - protein, 6 aa, synthetic construct
GGSGGG

SEQ ID NO: 15275 - protein, 11 aa, synthetic construct
EAAAKGGSPAP

SEQ ID NO: 15276 - protein, 11 aa, synthetic construct
GGSPAPEAAAK

SEQ ID NO: 15277 - protein, 11 aa, synthetic construct
GSSGGSEAAAK

SEQ ID NO: 15278 - protein, 12 aa, synthetic construct
GSAGSAAGSGEF

SEQ ID NO: 15279 - protein, 9 aa, synthetic construct
PAPGGSGSS

SEQ ID NO: 15280 - protein, 11 aa, synthetic construct
GGSEAAAKGGG

SEQ ID NO: 15281 - protein, 9 aa, synthetic construct
GGSPAPGSS

SEQ ID NO: 15282 - protein, 9 aa, synthetic construct
GSSGGSGGG

SEQ ID NO: 15283 - protein, 11 aa, synthetic construct
PAPEAAAKGGG

SEQ ID NO: 15284 - protein, 11 aa, synthetic construct
GGGEAAAKPAP

SEQ ID NO: 15285 - protein, 8 aa, synthetic construct
GGSEAAAK

SEQ ID NO: 15286 - protein, 11 aa, synthetic construct
GGGEAAAKGSS

SEQ ID NO: 15287 - protein, 11 aa, synthetic construct
GGGGGSEAAAK

SEQ ID NO: 15288 - protein, 11 aa, synthetic construct
PAPAPAPAPAP

SEQ ID NO: 15289 - protein, 11 aa, synthetic construct
PAPAPAPAPAP

SEQ ID NO: 15290 - protein, 9 aa, synthetic construct
GGGGSSGGS

SEQ ID NO: 15291 - protein, 11 aa, synthetic construct
PAPGGSEAAAK

SEQ ID NO: 15292 - protein, 11 aa, synthetic construct
PAPAPAPAPAP

SEQ ID NO: 15293 - protein, 11 aa, synthetic construct
EAAAKPAPGGG

SEQ ID NO: 15294 - protein, 8 aa, synthetic construct
GGSEAAAK

SEQ ID NO: 15295 - protein, 11 aa, synthetic construct
GGGEAAAKGSS

SEQ ID NO: 15296 - protein, 9 aa, synthetic construct
GGSPAPGSS

SEQ ID NO: 15297 - protein, 11 aa, synthetic construct
GGSEAAAKPAP

SEQ ID NO: 15298 - protein, 11 aa, synthetic construct
PAPEAAAKGGG

SEQ ID NO: 15299 - protein, 11 aa, synthetic construct
GSSEAAAKPAP

SEQ ID NO: 15300 - protein, 15 aa, synthetic construct
GGGGSEAAAKGGGGS

SEQ ID NO: 15301 - protein, 11 aa, synthetic construct
GSSEAAAKGGS

SEQ ID NO: 15302 - protein, 15 aa, synthetic construct
GSSGSSGSSGSSGSS

SEQ ID NO: 15303 - protein, 9 aa, synthetic construct
GGGGGSPAP

SEQ ID NO: 15304 - protein, 8 aa, synthetic construct
GGSEAAAK

SEQ ID NO: 15305 - protein, 11 aa, synthetic construct
GSSPAPEAAAK

SEQ ID NO: 15306 - protein, 9 aa, synthetic construct
GGGPAPGGS

SEQ ID NO: 15307 - protein, 11 aa, synthetic construct
GGSPAPEAAAK

SEQ ID NO: 15308 - protein, 11 aa, synthetic construct
GGSEAAAKPAP

SEQ ID NO: 15309 - protein, 9 aa, synthetic construct
PAPAPAPAP

SEQ ID NO: 15310 - protein, 9 aa, synthetic construct
GSSPAPGGG

SEQ ID NO: 15311 - protein, 12 aa, synthetic construct
GSSGSSGSSGSS

SEQ ID NO: 15312 - protein, 11 aa, synthetic construct
GGSEAAAKGSS

SEQ ID NO: 15313 - protein, 9 aa, synthetic construct
GGSGSSGGG

SEQ ID NO: 15314 - protein, 18 aa, synthetic construct
GSSGSSGSSGSSGSSGSS

SEQ ID NO: 15315 - protein, 11 aa, synthetic construct
GGSEAAAKPAP

SEQ ID NO: 15316 - protein, 9 aa, synthetic construct
GSSGGSGGG

SEQ ID NO: 15317 - protein, 46 aa, synthetic construct; identical to SEQ ID NO: 5217

SEQ ID NO: 15318 - protein, 11 aa, synthetic construct
GGSPAPEAAAK

SEQ ID NO: 15319 - protein, 11 aa, synthetic construct
GGGGSSEAAAK

SEQ ID NO: 15320 - protein, 11 aa, synthetic construct
GGSGGGEAAAK

SEQ ID NO: 15321 - protein, 15 aa, synthetic construct
GGGGSEAAAKGGGGS

SEQ ID NO: 15322 - protein, 11 aa, synthetic construct
GGSGSSEAAAK

SEQ ID NO: 15323 - protein, 11 aa, synthetic construct
GGSEAAAKPAP

SEQ ID NO: 15324 - protein, 11 aa, synthetic construct
GSSGGGEAAAK

SEQ ID NO: 15325 - protein, 6 aa, synthetic construct
GSSGGS

SEQ ID NO: 15326 - protein, 11 aa, synthetic construct
GGSEAAAKPAP

SEQ ID NO: 15327 - protein, 11 aa, synthetic construct
GSSGGSEAAAK

SEQ ID NO: 15328 - protein, 11 aa, synthetic construct
GSSPAPEAAAK

SEQ ID NO: 15329 - protein, 18 aa, synthetic construct
GGSGGSGGSGGSGGSGGS

SEQ ID NO: 15330 - protein, 15 aa, synthetic construct
GSSGSSGSSGSSGSS

SEQ ID NO: 15331 - protein, 11 aa, synthetic construct
EAAAKGGGGSS

SEQ ID NO: 15332 - protein, 11 aa, synthetic construct
GGGEAAAKGSS

SEQ ID NO: 15333-15400 - skipped (68 entries)

SEQ ID NO: 15401 - protein, 46 aa, synthetic construct; identical to SEQ ID NO: 5217

SEQ ID NO: 15402 - protein, 46 aa, synthetic construct; identical to SEQ ID NO: 5217

SEQ ID NO: 15403 - protein, 46 aa, synthetic construct; identical to SEQ ID NO: 5217

SEQ ID NO: 15404 - protein, 46 aa, synthetic construct; identical to SEQ ID NO: 5217

SEQ ID NO: 15405 - protein, 20 aa, synthetic construct
GGGGSGGGGSGGGGSGGGGS

SEQ ID NO: 15406 - protein, 30 aa, synthetic construct; identical to SEQ ID NO: 5112

SEQ ID NO: 15407 - protein, 30 aa, synthetic construct; identical to SEQ ID NO: 5112

SEQ ID NO: 15408 - protein, 18 aa, synthetic construct
GSSGSSGSSGSSGSSGSS

SEQ ID NO: 15409 - protein, 20 aa, synthetic construct
EAAAKEAAAKEAAAKEAAAK

SEQ ID NO: 15410 - protein, 30 aa, synthetic construct; identical to SEQ ID NO: 5130

SEQ ID NO: 15411 - protein, 11 aa, synthetic construct
PAPAPAPAPAP

SEQ ID NO: 15412 - protein, 13 aa, synthetic construct
PAPAPAPAPAPAP

SEQ ID NO: 15413 - protein, 13 aa, synthetic construct
PAPAPAPAPAPAP

SEQ ID NO: 15414 - protein, 13 aa, synthetic construct
PAPAPAPAPAPAP

SEQ ID NO: 15415 - protein, 13 aa, synthetic construct
PAPAPAPAPAPAP

SEQ ID NO: 15416 - protein, 13 aa, synthetic construct
PAPAPAPAPAPAP

SEQ ID NO: 15417 - protein, 8 aa, synthetic construct
EAAAKGGG

SEQ ID NO: 15418 - protein, 8 aa, synthetic construct
EAAAKGGG

SEQ ID NO: 15419 - protein, 6 aa, synthetic construct
PAPGGG

SEQ ID NO: 15420 - protein, 9 aa, synthetic construct
GGGGSSGGS

SEQ ID NO: 15421 - protein, 11 aa, synthetic construct
GGGGGSEAAAK

SEQ ID NO: 15422 - protein, 11 aa, synthetic construct
GGGEAAAKGGS

SEQ ID NO: 15423 - protein, 11 aa, synthetic construct
GGGEAAAKGGS

SEQ ID NO: 15424 - protein, 11 aa, synthetic construct
GGGEAAAKGGS

SEQ ID NO: 15425 - protein, 9 aa, synthetic construct
GGSGGGPAP

SEQ ID NO: 15426 - protein, 9 aa, synthetic construct
PAPGGSGGG

SEQ ID NO: 15427 - protein, 9 aa, synthetic construct
PAPGGSGGG

SEQ ID NO: 15428 - protein, 11 aa, synthetic construct
GGSEAAAKPAP

SEQ ID NO: 15429 - protein, 11 aa, synthetic construct
GGSPAPEAAAK

SEQ ID NO: 15430 - protein, 11 aa, synthetic construct
GGSPAPEAAAK

SEQ ID NO: 15431 - protein, 11 aa, synthetic construct
EAAAKGGSPAP

SEQ ID NO: 15432 - protein, 11 aa, synthetic construct
EAAAKGGSPAP

SEQ ID NO: 15433 - protein, 11 aa, synthetic construct
EAAAKPAPGGS

SEQ ID NO: 15434 - protein, 11 aa, synthetic construct
EAAAKPAPGGS

SEQ ID NO: 15435 - protein, 11 aa, synthetic construct
GGGGSSEAAAK

SEQ ID NO: 15436 - protein, 11 aa, synthetic construct
GGGGSSEAAAK

SEQ ID NO: 15437 - protein, 11 aa, synthetic construct
GSSGGGEAAAK

SEQ ID NO: 15438 - protein, 11 aa, synthetic construct
GSSGGGEAAAK

SEQ ID NO: 15439 - protein, 11 aa, synthetic construct
GSSEAAAKGGG

SEQ ID NO: 15440 - protein, 9 aa, synthetic construct
GSSGGGPAP

SEQ ID NO: 15441 - protein, 9 aa, synthetic construct
GSSPAPGGG

SEQ ID NO: 15442 - protein, 9 aa, synthetic construct
PAPGGGGSS

SEQ ID NO: 15443 - protein, 11 aa, synthetic construct
GGGEAAAKPAP

SEQ ID NO: 15444 - protein, 11 aa, synthetic construct
GGGEAAAKPAP

SEQ ID NO: 15445 - protein, 11 aa, synthetic construct
GGGPAPEAAAK

SEQ ID NO: 15446 - protein, 11 aa, synthetic construct
GSSEAAAKPAP

SEQ ID NO: 15447 - protein, 11 aa, synthetic construct
GSSEAAAKPAP

SEQ ID NO: 15448 - protein, 11 aa, synthetic construct
GSSPAPEAAAK

SEQ ID NO: 15449 - protein, 11 aa, synthetic construct
GSSPAPEAAAK

SEQ ID NO: 15450 - protein, 11 aa, synthetic construct
GSSPAPEAAAK

SEQ ID NO: 15451 - protein, 11 aa, synthetic construct
PAPGSSEAAAK

SEQ ID NO: 15452 - protein, 11 aa, synthetic construct
PAPGSSEAAAK

SEQ ID NO: 15453 - protein, 46 aa, synthetic construct; identical to SEQ ID NO: 5217

SEQ ID NO: 15454 - protein, 46 aa, synthetic construct; identical to SEQ ID NO: 5217

SEQ ID NO: 15455 - protein, 46 aa, synthetic construct; identical to SEQ ID NO: 5217

SEQ ID NO: 15456 - protein, 46 aa, synthetic construct; identical to SEQ ID NO: 5217

SEQ ID NO: 15457 - protein, 46 aa, synthetic construct; identical to SEQ ID NO: 5217

SEQ ID NO: 15458 - protein, 46 aa, synthetic construct; identical to SEQ ID NO: 5217

SEQ ID NO: 15459 - protein, 46 aa, synthetic construct; identical to SEQ ID NO: 5217

SEQ ID NO: 15460 - protein, 16 aa, synthetic construct
SGSETPGTSESATPES

SEQ ID NO: 15461-16920 - skipped (1460 entries)

SEQ ID NO: 16921 - DNA, 20 bp, synthetic construct
  source 1..20: mol_type = other DNA
cattaaagaaaatatcattg

SEQ ID NO: 16922 - DNA, 20 bp, synthetic construct
  source 1..20: mol_type = other DNA
attcatcataggaaacacca

SEQ ID NO: 16923 - DNA, 20 bp, synthetic construct
  source 1..20: mol_type = other DNA
cattaaagaaaatatcattg

SEQ ID NO: 16924 - DNA, 20 bp, synthetic construct
  source 1..20: mol_type = other DNA
attcatcataggaaacacca

SEQ ID NO: 16925 - DNA, 22 bp, synthetic construct
  source 1..22: mol_type = other DNA
accattaaagaaaatatcattg

SEQ ID NO: 16926 - DNA, 22 bp, synthetic construct
  source 1..22: mol_type = other DNA
atattcatcataggaaacacca

SEQ ID NO: 16927 - DNA, 20 bp, synthetic construct
  source 1..20: mol_type = other DNA
cattaaagaaaatatcattg

SEQ ID NO: 16928 - DNA, 20 bp, synthetic construct
  source 1..20: mol_type = other DNA
attcatcataggaaacacca

SEQ ID NO: 16929 - DNA, 20 bp, synthetic construct
  source 1..20: mol_type = other DNA
cattaaagaaaatatcattg

SEQ ID NO: 16930 - DNA, 20 bp, synthetic construct
  source 1..20: mol_type = other DNA
attcatcataggaaacacca

SEQ ID NO: 16931 - DNA, 21 bp, synthetic construct
  source 1..21: mol_type = other DNA
atattcatcataggaaacacc

SEQ ID NO: 16932 - DNA, 21 bp, synthetic construct
  source 1..21: mol_type = other DNA
atattcatcataggaaacacc

SEQ ID NO: 16933 - DNA, 20 bp, synthetic construct
  source 1..20: mol_type = other DNA
ccattaaagaaaatatcatt

SEQ ID NO: 16934 - DNA, 20 bp, synthetic construct
  source 1..20: mol_type = other DNA
ccattaaagaaaatatcatt

SEQ ID NO: 16935 - DNA, 20 bp, synthetic construct
  source 1..20: mol_type = other DNA
tattcatcataggaaacacc

SEQ ID NO: 16936 - DNA, 20 bp, synthetic construct
  source 1..20: mol_type = other DNA
ccattaaagaaaatatcatt

SEQ ID NO: 16937 - DNA, 20 bp, synthetic construct
  source 1..20: mol_type = other DNA
ccattaaagaaaatatcatt

SEQ ID NO: 16938 - DNA, 20 bp, synthetic construct
  source 1..20: mol_type = other DNA
ccattaaagaaaatatcatt

SEQ ID NO: 16939 - DNA, 24 bp, synthetic construct
  source 1..24: mol_type = other DNA
tggcaccattaaagaaaatatcat

SEQ ID NO: 16940 - DNA, 20 bp, synthetic construct
  source 1..20: mol_type = other DNA
accattaaagaaaatatcat

SEQ ID NO: 16941 - DNA, 20 bp, synthetic construct
  source 1..20: mol_type = other DNA
accattaaagaaaatatcat

SEQ ID NO: 16942 - DNA, 20 bp, synthetic construct
  source 1..20: mol_type = other DNA
accattaaagaaaatatcat

SEQ ID NO: 16943 - DNA, 20 bp, synthetic construct
  source 1..20: mol_type = other DNA
accattaaagaaaatatcat

SEQ ID NO: 16944 - DNA, 20 bp, synthetic construct
  source 1..20: mol_type = other DNA
atattcatcataggaaacac

SEQ ID NO: 16945 - DNA, 21 bp, synthetic construct
  source 1..21: mol_type = other DNA
tatattcatcataggaaacac

SEQ ID NO: 16946 - DNA, 24 bp, synthetic construct
  source 1..24: mol_type = other DNA
tggcaccattaaagaaaatatcat

SEQ ID NO: 16947 - DNA, 24 bp, synthetic construct
  source 1..24: mol_type = other DNA
atctatattcatcataggaaacac

SEQ ID NO: 16948 - DNA, 20 bp, synthetic construct
  source 1..20: mol_type = other DNA
accattaaagaaaatatcat

SEQ ID NO: 16949 - DNA, 20 bp, synthetic construct
  source 1..20: mol_type = other DNA
accattaaagaaaatatcat

SEQ ID NO: 16950 - DNA, 20 bp, synthetic construct
  source 1..20: mol_type = other DNA
accattaaagaaaatatcat

SEQ ID NO: 16951 - DNA, 20 bp, synthetic construct
  source 1..20: mol_type = other DNA
atattcatcataggaaacac

SEQ ID NO: 16952 - DNA, 20 bp, synthetic construct
  source 1..20: mol_type = other DNA
accattaaagaaaatatcat

SEQ ID NO: 16953 - DNA, 20 bp, synthetic construct
  source 1..20: mol_type = other DNA
accattaaagaaaatatcat

SEQ ID NO: 16954 - DNA, 20 bp, synthetic construct
  source 1..20: mol_type = other DNA
accattaaagaaaatatcat

SEQ ID NO: 16955 - DNA, 20 bp, synthetic construct
  source 1..20: mol_type = other DNA
accattaaagaaaatatcat

SEQ ID NO: 16956 - DNA, 21 bp, synthetic construct
  source 1..21: mol_type = other DNA
gcaccattaaagaaaatatca

SEQ ID NO: 16957 - DNA, 21 bp, synthetic construct
  source 1..21: mol_type = other DNA
gcaccattaaagaaaatatca

SEQ ID NO: 16958 - DNA, 20 bp, synthetic construct
  source 1..20: mol_type = other DNA
caccattaaagaaaatatca

SEQ ID NO: 16959 - DNA, 20 bp, synthetic construct
  source 1..20: mol_type = other DNA
caccattaaagaaaatatca

SEQ ID NO: 16960 - DNA, 20 bp, synthetic construct
  source 1..20: mol_type = other DNA
tatattcatcataggaaaca

SEQ ID NO: 16961 - DNA, 21 bp, synthetic construct
  source 1..21: mol_type = other DNA
gcaccattaaagaaaatatca

SEQ ID NO: 16962 - DNA, 21 bp, synthetic construct
  source 1..21: mol_type = other DNA
ctatattcatcataggaaaca

SEQ ID NO: 16963 - DNA, 21 bp, synthetic construct
  source 1..21: mol_type = other DNA
gcaccattaaagaaaatatca

SEQ ID NO: 16964 - DNA, 21 bp, synthetic construct
  source 1..21: mol_type = other DNA
ctatattcatcataggaaaca

SEQ ID NO: 16965 - DNA, 20 bp, synthetic construct
  source 1..20: mol_type = other DNA
caccattaaagaaaatatca

SEQ ID NO: 16966 - DNA, 20 bp, synthetic construct
  source 1..20: mol_type = other DNA
caccattaaagaaaatatca

SEQ ID NO: 16967 - DNA, 21 bp, synthetic construct
  source 1..21: mol_type = other DNA
ggcaccattaaagaaaatatc

SEQ ID NO: 16968 - DNA, 21 bp, synthetic construct
  source 1..21: mol_type = other DNA
ggcaccattaaagaaaatatc

SEQ ID NO: 16969 - DNA, 21 bp, synthetic construct
  source 1..21: mol_type = other DNA
tctatattcatcataggaaac

SEQ ID NO: 16970 - DNA, 21 bp, synthetic construct
  source 1..21: mol_type = other DNA
tctatattcatcataggaaac

SEQ ID NO: 16971 - DNA, 20 bp, synthetic construct
  source 1..20: mol_type = other DNA
gcaccattaaagaaaatatc

SEQ ID NO: 16972 - DNA, 20 bp, synthetic construct
  source 1..20: mol_type = other DNA
ctatattcatcataggaaac

SEQ ID NO: 16973 - DNA, 21 bp, synthetic construct
  source 1..21: mol_type = other DNA
tctatattcatcataggaaac

SEQ ID NO: 16974 - DNA, 21 bp, synthetic construct
  source 1..21: mol_type = other DNA
tctatattcatcataggaaac

SEQ ID NO: 16975 - DNA, 20 bp, synthetic construct
  source 1..20: mol_type = other DNA
ggcaccattaaagaaaatat

SEQ ID NO: 16976 - DNA, 20 bp, synthetic construct
  source 1..20: mol_type = other DNA
tctatattcatcataggaaa

SEQ ID NO: 16977 - DNA, 20 bp, synthetic construct
  source 1..20: mol_type = other DNA
ggcaccattaaagaaaatat

SEQ ID NO: 16978 - DNA, 20 bp, synthetic construct
  source 1..20: mol_type = other DNA
tctatattcatcataggaaa

SEQ ID NO: 16979 - DNA, 20 bp, synthetic construct
  source 1..20: mol_type = other DNA
tggcaccattaaagaaaata

SEQ ID NO: 16980 - DNA, 20 bp, synthetic construct
  source 1..20: mol_type = other DNA
atctatattcatcataggaa

SEQ ID NO: 16981 - DNA, 23 bp, synthetic construct
  source 1..23: mol_type = other DNA
tgtatctatattcatcataggaa

SEQ ID NO: 16982 - DNA, 23 bp, synthetic construct
  source 1..23: mol_type = other DNA
tgtatctatattcatcataggaa

SEQ ID NO: 16983 - DNA, 24 bp, synthetic construct
  source 1..24: mol_type = other DNA
tctgtatctatattcatcatagga

SEQ ID NO: 16984 - DNA, 20 bp, synthetic construct
  source 1..20: mol_type = other DNA
ctggcaccattaaagaaaat

SEQ ID NO: 16985 - DNA, 20 bp, synthetic construct
  source 1..20: mol_type = other DNA
tatctatattcatcatagga

SEQ ID NO: 16986 - DNA, 23 bp, synthetic construct
  source 1..23: mol_type = other DNA
ctgtatctatattcatcatagga

SEQ ID NO: 16987 - DNA, 23 bp, synthetic construct
  source 1..23: mol_type = other DNA
ctgtatctatattcatcatagga

SEQ ID NO: 16988 - DNA, 23 bp, synthetic construct
  source 1..23: mol_type = other DNA
ctgtatctatattcatcatagga

SEQ ID NO: 16989 - DNA, 21 bp, synthetic construct
  source 1..21: mol_type = other DNA
cctggcaccattaaagaaaat

SEQ ID NO: 16990 - DNA, 21 bp, synthetic construct
  source 1..21: mol_type = other DNA
cctggcaccattaaagaaaat

SEQ ID NO: 16991 - DNA, 20 bp, synthetic construct
  source 1..20: mol_type = other DNA
tatctatattcatcatagga

SEQ ID NO: 16992 - DNA, 24 bp, synthetic construct
  source 1..24: mol_type = other DNA
tatgcctggcaccattaaagaaaa

SEQ ID NO: 16993 - DNA, 20 bp, synthetic construct
  source 1..20: mol_type = other DNA
cctggcaccattaaagaaaa

SEQ ID NO: 16994 - DNA, 20 bp, synthetic construct
  source 1..20: mol_type = other DNA
gtatctatattcatcatagg

SEQ ID NO: 16995 - DNA, 22 bp, synthetic construct
  source 1..22: mol_type = other DNA
ctgtatctatattcatcatagg

SEQ ID NO: 16996 - DNA, 21 bp, synthetic construct
  source 1..21: mol_type = other DNA
tgtatctatattcatcatagg

SEQ ID NO: 16997 - DNA, 20 bp, synthetic construct
  source 1..20: mol_type = other DNA
gtatctatattcatcatagg

SEQ ID NO: 16998 - DNA, 20 bp, synthetic construct
  source 1..20: mol_type = other DNA
cctggcaccattaaagaaaa

SEQ ID NO: 16999 - DNA, 20 bp, synthetic construct
  source 1..20: mol_type = other DNA
gcctggcaccattaaagaaa

SEQ ID NO: 17000 - DNA, 20 bp, synthetic construct
  source 1..20: mol_type = other DNA
tgtatctatattcatcatag

SEQ ID NO: 17001 - DNA, 23 bp, synthetic construct
  source 1..23: mol_type = other DNA
tatgcctggcaccattaaagaaa

SEQ ID NO: 17002 - DNA, 23 bp, synthetic construct
  source 1..23: mol_type = other DNA
tatgcctggcaccattaaagaaa

SEQ ID NO: 17003 - DNA, 23 bp, synthetic construct
  source 1..23: mol_type = other DNA
ttctgtatctatattcatcatag

SEQ ID NO: 17004 - DNA, 22 bp, synthetic construct
  source 1..22: mol_type = other DNA
atgcctggcaccattaaagaaa

SEQ ID NO: 17005 - DNA, 22 bp, synthetic construct
  source 1..22: mol_type = other DNA
tctgtatctatattcatcatag

SEQ ID NO: 17006 - DNA, 21 bp, synthetic construct
  source 1..21: mol_type = other DNA
ctgtatctatattcatcatag

SEQ ID NO: 17007 - DNA, 20 bp, synthetic construct
  source 1..20: mol_type = other DNA
tgtatctatattcatcatag

SEQ ID NO: 17008 - DNA, 20 bp, synthetic construct
  source 1..20: mol_type = other DNA
tgtatctatattcatcatag

SEQ ID NO: 17009 - DNA, 21 bp, synthetic construct
  source 1..21: mol_type = other DNA
tctgtatctatattcatcata

SEQ ID NO: 17010 - DNA, 20 bp, synthetic construct
  source 1..20: mol_type = other DNA
ctgtatctatattcatcata

SEQ ID NO: 17011 - DNA, 20 bp, synthetic construct
  source 1..20: mol_type = other DNA
tgcctggcaccattaaagaa

SEQ ID NO: 17012 - DNA, 20 bp, synthetic construct
  source 1..20: mol_type = other DNA
ctgtatctatattcatcata

SEQ ID NO: 17013 - DNA, 21 bp, synthetic construct
  source 1..21: mol_type = other DNA
tctgtatctatattcatcata

SEQ ID NO: 17014 - DNA, 21 bp, synthetic construct
  source 1..21: mol_type = other DNA
tctgtatctatattcatcata

SEQ ID NO: 17015 - DNA, 23 bp, synthetic construct
  source 1..23: mol_type = other DNA
cttctgtatctatattcatcata

SEQ ID NO: 17016 - DNA, 20 bp, synthetic construct
  source 1..20: mol_type = other DNA
ctgtatctatattcatcata

SEQ ID NO: 17017 - DNA, 20 bp, synthetic construct
  source 1..20: mol_type = other DNA
tgcctggcaccattaaagaa

SEQ ID NO: 17018 - DNA, 20 bp, synthetic construct
  source 1..20: mol_type = other DNA
ctgtatctatattcatcata

SEQ ID NO: 17019 - DNA, 20 bp, synthetic construct
  source 1..20: mol_type = other DNA
ctgtatctatattcatcata

SEQ ID NO: 17020 - DNA, 20 bp, synthetic construct
  source 1..20: mol_type = other DNA
ctgtatctatattcatcata

SEQ ID NO: 17021 - DNA, 20 bp, synthetic construct
  source 1..20: mol_type = other DNA
ctgtatctatattcatcata

SEQ ID NO: 17022 - DNA, 23 bp, synthetic construct
  source 1..23: mol_type = other DNA
gcttctgtatctatattcatcat

SEQ ID NO: 17023 - DNA, 21 bp, synthetic construct
  source 1..21: mol_type = other DNA
ttctgtatctatattcatcat

SEQ ID NO: 17024 - DNA, 20 bp, synthetic construct
  source 1..20: mol_type = other DNA
tctgtatctatattcatcat

SEQ ID NO: 17025 - DNA, 20 bp, synthetic construct
  source 1..20: mol_type = other DNA
tctgtatctatattcatcat

SEQ ID NO: 17026 - DNA, 20 bp, synthetic construct
  source 1..20: mol_type = other DNA
tctgtatctatattcatcat

SEQ ID NO: 17027 - DNA, 20 bp, synthetic construct
  source 1..20: mol_type = other DNA
atgcctggcaccattaaaga

SEQ ID NO: 17028 - DNA, 20 bp, synthetic construct
  source 1..20: mol_type = other DNA
tctgtatctatattcatcat

SEQ ID NO: 17029 - DNA, 21 bp, synthetic construct
  source 1..21: mol_type = other DNA
ttctgtatctatattcatcat

SEQ ID NO: 17030 - DNA, 21 bp, synthetic construct
  source 1..21: mol_type = other DNA
ttctgtatctatattcatcat

SEQ ID NO: 17031 - DNA, 22 bp, synthetic construct
  source 1..22: mol_type = other DNA
ttatgcctggcaccattaaaga

SEQ ID NO: 17032 - DNA, 22 bp, synthetic construct
  source 1..22: mol_type = other DNA
cttctgtatctatattcatcat

SEQ ID NO: 17033 - DNA, 22 bp, synthetic construct
  source 1..22: mol_type = other DNA
cttctgtatctatattcatcat

SEQ ID NO: 17034 - DNA, 21 bp, synthetic construct
  source 1..21: mol_type = other DNA
tatgcctggcaccattaaaga

SEQ ID NO: 17035 - DNA, 20 bp, synthetic construct
  source 1..20: mol_type = other DNA
tctgtatctatattcatcat

SEQ ID NO: 17036 - DNA, 20 bp, synthetic construct
  source 1..20: mol_type = other DNA
tctgtatctatattcatcat

SEQ ID NO: 17037 - DNA, 20 bp, synthetic construct
  source 1..20: mol_type = other DNA
atgcctggcaccattaaaga

SEQ ID NO: 17038 - DNA, 20 bp, synthetic construct
  source 1..20: mol_type = other DNA
tctgtatctatattcatcat

SEQ ID NO: 17039 - DNA, 20 bp, synthetic construct
  source 1..20: mol_type = other DNA
tctgtatctatattcatcat

SEQ ID NO: 17040 - DNA, 20 bp, synthetic construct
  source 1..20: mol_type = other DNA
tctgtatctatattcatcat

SEQ ID NO: 17041 - DNA, 20 bp, synthetic construct
  source 1..20: mol_type = other DNA
tctgtatctatattcatcat

SEQ ID NO: 17042 - DNA, 20 bp, synthetic construct
  source 1..20: mol_type = other DNA
tctgtatctatattcatcat

SEQ ID NO: 17043 - DNA, 20 bp, synthetic construct
  source 1..20: mol_type = other DNA
tctgtatctatattcatcat

SEQ ID NO: 17044 - DNA, 23 bp, synthetic construct
  source 1..23: mol_type = other DNA
cgcttctgtatctatattcatca

SEQ ID NO: 17045 - DNA, 21 bp, synthetic construct
  source 1..21: mol_type = other DNA
cttctgtatctatattcatca

SEQ ID NO: 17046 - DNA, 21 bp, synthetic construct
  source 1..21: mol_type = other DNA
cttctgtatctatattcatca

SEQ ID NO: 17047 - DNA, 21 bp, synthetic construct
  source 1..21: mol_type = other DNA
cttctgtatctatattcatca

SEQ ID NO: 17048 - DNA, 20 bp, synthetic construct
  source 1..20: mol_type = other DNA
ttctgtatctatattcatca

SEQ ID NO: 17049 - DNA, 20 bp, synthetic construct
  source 1..20: mol_type = other DNA
tatgcctggcaccattaaag

SEQ ID NO: 17050 - DNA, 20 bp, synthetic construct
  source 1..20: mol_type = other DNA
ttctgtatctatattcatca

SEQ ID NO: 17051 - DNA, 20 bp, synthetic construct
  source 1..20: mol_type = other DNA
ttctgtatctatattcatca

SEQ ID NO: 17052 - DNA, 21 bp, synthetic construct
  source 1..21: mol_type = other DNA
cttctgtatctatattcatca

SEQ ID NO: 17053 - DNA, 21 bp, synthetic construct
  source 1..21: mol_type = other DNA
cttctgtatctatattcatca

SEQ ID NO: 17054 - DNA, 22 bp, synthetic construct
  source 1..22: mol_type = other DNA
attatgcctggcaccattaaag

SEQ ID NO: 17055 - DNA, 21 bp, synthetic construct
  source 1..21: mol_type = other DNA
ttatgcctggcaccattaaag

SEQ ID NO: 17056 - DNA, 20 bp, synthetic construct
  source 1..20: mol_type = other DNA
ttctgtatctatattcatca

SEQ ID NO: 17057 - DNA, 20 bp, synthetic construct
  source 1..20: mol_type = other DNA
ttctgtatctatattcatca

SEQ ID NO: 17058 - DNA, 20 bp, synthetic construct
  source 1..20: mol_type = other DNA
tatgcctggcaccattaaag

SEQ ID NO: 17059 - DNA, 21 bp, synthetic construct
  source 1..21: mol_type = other DNA
attatgcctggcaccattaaa

SEQ ID NO: 17060 - DNA, 21 bp, synthetic construct
  source 1..21: mol_type = other DNA
attatgcctggcaccattaaa

SEQ ID NO: 17061 - DNA, 21 bp, synthetic construct
  source 1..21: mol_type = other DNA
gcttctgtatctatattcatc

SEQ ID NO: 17062 - DNA, 21 bp, synthetic construct
  source 1..21: mol_type = other DNA
gcttctgtatctatattcatc

SEQ ID NO: 17063 - DNA, 20 bp, synthetic construct
  source 1..20: mol_type = other DNA
ttatgcctggcaccattaaa

SEQ ID NO: 17064 - DNA, 20 bp, synthetic construct
  source 1..20: mol_type = other DNA
cttctgtatctatattcatc

SEQ ID NO: 17065 - DNA, 20 bp, synthetic construct
  source 1..20: mol_type = other DNA
cttctgtatctatattcatc

SEQ ID NO: 17066 - DNA, 21 bp, synthetic construct
  source 1..21: mol_type = other DNA
attatgcctggcaccattaaa

SEQ ID NO: 17067 - DNA, 21 bp, synthetic construct
  source 1..21: mol_type = other DNA
gcttctgtatctatattcatc

SEQ ID NO: 17068 - DNA, 21 bp, synthetic construct
  source 1..21: mol_type = other DNA
attatgcctggcaccattaaa

SEQ ID NO: 17069 - DNA, 21 bp, synthetic construct
  source 1..21: mol_type = other DNA
gcttctgtatctatattcatc

SEQ ID NO: 17070 - DNA, 21 bp, synthetic construct
  source 1..21: mol_type = other DNA
attatgcctggcaccattaaa

SEQ ID NO: 17071 - DNA, 20 bp, synthetic construct
  source 1..20: mol_type = other DNA
ttatgcctggcaccattaaa

SEQ ID NO: 17072 - DNA, 20 bp, synthetic construct
  source 1..20: mol_type = other DNA
ttatgcctggcaccattaaa

SEQ ID NO: 17073 - DNA, 21 bp, synthetic construct
  source 1..21: mol_type = other DNA
gattatgcctggcaccattaa

SEQ ID NO: 17074 - DNA, 21 bp, synthetic construct
  source 1..21: mol_type = other DNA
cgcttctgtatctatattcat

SEQ ID NO: 17075 - DNA, 20 bp, synthetic construct
  source 1..20: mol_type = other DNA
attatgcctggcaccattaa

SEQ ID NO: 17076 - DNA, 20 bp, synthetic construct
  source 1..20: mol_type = other DNA
attatgcctggcaccattaa

SEQ ID NO: 17077 - DNA, 20 bp, synthetic construct
  source 1..20: mol_type = other DNA
gcttctgtatctatattcat

SEQ ID NO: 17078 - DNA, 21 bp, synthetic construct
  source 1..21: mol_type = other DNA
gattatgcctggcaccattaa

SEQ ID NO: 17079 - DNA, 21 bp, synthetic construct
  source 1..21: mol_type = other DNA
gattatgcctggcaccattaa

SEQ ID NO: 17080 - DNA, 22 bp, synthetic construct
  source 1..22: mol_type = other DNA
ggattatgcctggcaccattaa

SEQ ID NO: 17081 - DNA, 22 bp, synthetic construct
  source 1..22: mol_type = other DNA
ggattatgcctggcaccattaa

SEQ ID NO: 17082 - DNA, 20 bp, synthetic construct
  source 1..20: mol_type = other DNA
attatgcctggcaccattaa

SEQ ID NO: 17083 - DNA, 20 bp, synthetic construct
  source 1..20: mol_type = other DNA
gcttctgtatctatattcat

SEQ ID NO: 17084 - DNA, 20 bp, synthetic construct
  source 1..20: mol_type = other DNA
attatgcctggcaccattaa

SEQ ID NO: 17085 - DNA, 20 bp, synthetic construct
  source 1..20: mol_type = other DNA
attatgcctggcaccattaa

SEQ ID NO: 17086 - DNA, 20 bp, synthetic construct
  source 1..20: mol_type = other DNA
attatgcctggcaccattaa

SEQ ID NO: 17087 - DNA, 20 bp, synthetic construct
  source 1..20: mol_type = other DNA
attatgcctggcaccattaa

SEQ ID NO: 17088 - DNA, 20 bp, synthetic construct
  source 1..20: mol_type = other DNA
attatgcctggcaccattaa

SEQ ID NO: 17089 - DNA, 23 bp, synthetic construct
  source 1..23: mol_type = other DNA
ctggattatgcctggcaccatta

SEQ ID NO: 17090 - DNA, 21 bp, synthetic construct
  source 1..21: mol_type = other DNA
ggattatgcctggcaccatta

SEQ ID NO: 17091 - DNA, 20 bp, synthetic construct
  source 1..20: mol_type = other DNA
gattatgcctggcaccatta

SEQ ID NO: 17092 - DNA, 20 bp, synthetic construct
  source 1..20: mol_type = other DNA
gattatgcctggcaccatta

SEQ ID NO: 17093 - DNA, 20 bp, synthetic construct
  source 1..20: mol_type = other DNA
cgcttctgtatctatattca

SEQ ID NO: 17094 - DNA, 21 bp, synthetic construct
  source 1..21: mol_type = other DNA
ggattatgcctggcaccatta

SEQ ID NO: 17095 - DNA, 21 bp, synthetic construct
  source 1..21: mol_type = other DNA
ggattatgcctggcaccatta

SEQ ID NO: 17096 - DNA, 20 bp, synthetic construct
  source 1..20: mol_type = other DNA
gattatgcctggcaccatta

SEQ ID NO: 17097 - DNA, 20 bp, synthetic construct
  source 1..20: mol_type = other DNA
gattatgcctggcaccatta

SEQ ID NO: 17098 - DNA, 20 bp, synthetic construct
  source 1..20: mol_type = other DNA
gattatgcctggcaccatta

SEQ ID NO: 17099 - DNA, 20 bp, synthetic construct
  source 1..20: mol_type = other DNA
gattatgcctggcaccatta

SEQ ID NO: 17100 - DNA, 21 bp, synthetic construct
  source 1..21: mol_type = other DNA
tggattatgcctggcaccatt

SEQ ID NO: 17101 - DNA, 21 bp, synthetic construct
  source 1..21: mol_type = other DNA
tggattatgcctggcaccatt

SEQ ID NO: 17102 - DNA, 20 bp, synthetic construct
  source 1..20: mol_type = other DNA
ggattatgcctggcaccatt

SEQ ID NO: 17103 - DNA, 20 bp, synthetic construct
  source 1..20: mol_type = other DNA
acgcttctgtatctatattc

SEQ ID NO: 17104 - DNA, 20 bp, synthetic construct
  source 1..20: mol_type = other DNA
ggattatgcctggcaccatt

SEQ ID NO: 17105 - DNA, 21 bp, synthetic construct
  source 1..21: mol_type = other DNA
tggattatgcctggcaccatt

SEQ ID NO: 17106 - DNA, 21 bp, synthetic construct
  source 1..21: mol_type = other DNA
tggattatgcctggcaccatt

SEQ ID NO: 17107 - DNA, 21 bp, synthetic construct
  source 1..21: mol_type = other DNA
tggattatgcctggcaccatt

SEQ ID NO: 17108 - DNA, 20 bp, synthetic construct
  source 1..20: mol_type = other DNA
ggattatgcctggcaccatt

SEQ ID NO: 17109 - DNA, 21 bp, synthetic construct
  source 1..21: mol_type = other DNA
ctggattatgcctggcaccat

SEQ ID NO: 17110 - DNA, 20 bp, synthetic construct
  source 1..20: mol_type = other DNA
tggattatgcctggcaccat

SEQ ID NO: 17111 - DNA, 20 bp, synthetic construct
  source 1..20: mol_type = other DNA
gacgcttctgtatctatatt

SEQ ID NO: 17112 - DNA, 21 bp, synthetic construct
  source 1..21: mol_type = other DNA
ctggattatgcctggcaccat

SEQ ID NO: 17113 - DNA, 21 bp, synthetic construct
  source 1..21: mol_type = other DNA
ctggattatgcctggcaccat

SEQ ID NO: 17114 - DNA, 21 bp, synthetic construct
  source 1..21: mol_type = other DNA
ctggattatgcctggcaccat

SEQ ID NO: 17115 - DNA, 20 bp, synthetic construct
  source 1..20: mol_type = other DNA
tggattatgcctggcaccat

SEQ ID NO: 17116 - DNA, 20 bp, synthetic construct
  source 1..20: mol_type = other DNA
gacgcttctgtatctatatt

SEQ ID NO: 17117 - DNA, 21 bp, synthetic construct
  source 1..21: mol_type = other DNA
cctggattatgcctggcacca

SEQ ID NO: 17118 - DNA, 20 bp, synthetic construct
  source 1..20: mol_type = other DNA
ctggattatgcctggcacca

SEQ ID NO: 17119 - DNA, 20 bp, synthetic construct
  source 1..20: mol_type = other DNA
tgacgcttctgtatctatat

SEQ ID NO: 17120 - DNA, 23 bp, synthetic construct
  source 1..23: mol_type = other DNA
tgatgacgcttctgtatctatat

SEQ ID NO: 17121 - DNA, 23 bp, synthetic construct
  source 1..23: mol_type = other DNA
tgatgacgcttctgtatctatat

SEQ ID NO: 17122 - DNA, 21 bp, synthetic construct
  source 1..21: mol_type = other DNA
cctggattatgcctggcacca

SEQ ID NO: 17123 - DNA, 21 bp, synthetic construct
  source 1..21: mol_type = other DNA
cctggattatgcctggcacca

SEQ ID NO: 17124 - DNA, 22 bp, synthetic construct
  source 1..22: mol_type = other DNA
gatgacgcttctgtatctatat

SEQ ID NO: 17125 - DNA, 21 bp, synthetic construct
  source 1..21: mol_type = other DNA
tcctggattatgcctggcacc

SEQ ID NO: 17126 - DNA, 20 bp, synthetic construct
  source 1..20: mol_type = other DNA
cctggattatgcctggcacc

SEQ ID NO: 17127 - DNA, 20 bp, synthetic construct
  source 1..20: mol_type = other DNA
atgacgcttctgtatctata

SEQ ID NO: 17128 - DNA, 20 bp, synthetic construct
  source 1..20: mol_type = other DNA
tcctggattatgcctggcac

SEQ ID NO: 17129 - DNA, 20 bp, synthetic construct
  source 1..20: mol_type = other DNA
gatgacgcttctgtatctat

SEQ ID NO: 17130 - DNA, 20 bp, synthetic construct
  source 1..20: mol_type = other DNA
tcctggattatgcctggcac

SEQ ID NO: 17131 - DNA, 20 bp, synthetic construct
  source 1..20: mol_type = other DNA
ttcctggattatgcctggca

SEQ ID NO: 17132 - DNA, 20 bp, synthetic construct
  source 1..20: mol_type = other DNA
tgatgacgcttctgtatcta

SEQ ID NO: 17133 - DNA, 23 bp, synthetic construct
  source 1..23: mol_type = other DNA
ctttgatgacgcttctgtatcta

SEQ ID NO: 17134 - DNA, 20 bp, synthetic construct
  source 1..20: mol_type = other DNA
tgatgacgcttctgtatcta

SEQ ID NO: 17135 - DNA, 20 bp, synthetic construct
  source 1..20: mol_type = other DNA
tttcctggattatgcctggc

SEQ ID NO: 17136 - DNA, 20 bp, synthetic construct
  source 1..20: mol_type = other DNA
ttgatgacgcttctgtatct

SEQ ID NO: 17137 - DNA, 21 bp, synthetic construct
  source 1..21: mol_type = other DNA
ttttcctggattatgcctggc

SEQ ID NO: 17138 - DNA, 21 bp, synthetic construct
  source 1..21: mol_type = other DNA
ttttcctggattatgcctggc

SEQ ID NO: 17139 - DNA, 24 bp, synthetic construct
  source 1..24: mol_type = other DNA
tcagttttcctggattatgcctgg

SEQ ID NO: 17140 - DNA, 20 bp, synthetic construct
  source 1..20: mol_type = other DNA
ttttcctggattatgcctgg

SEQ ID NO: 17141 - DNA, 20 bp, synthetic construct
  source 1..20: mol_type = other DNA
tttgatgacgcttctgtatc

SEQ ID NO: 17142 - DNA, 20 bp, synthetic construct
  source 1..20: mol_type = other DNA
tttgatgacgcttctgtatc

SEQ ID NO: 17143 - DNA, 20 bp, synthetic construct
  source 1..20: mol_type = other DNA
ttttcctggattatgcctgg

SEQ ID NO: 17144 - DNA, 24 bp, synthetic construct
  source 1..24: mol_type = other DNA
catgctttgatgacgcttctgtat

SEQ ID NO: 17145 - DNA, 20 bp, synthetic construct
  source 1..20: mol_type = other DNA
gttttcctggattatgcctg

SEQ ID NO: 17146 - DNA, 20 bp, synthetic construct
  source 1..20: mol_type = other DNA
ctttgatgacgcttctgtat

SEQ ID NO: 17147 - DNA, 23 bp, synthetic construct
  source 1..23: mol_type = other DNA
tcagttttcctggattatgcctg

SEQ ID NO: 17148 - DNA, 23 bp, synthetic construct
  source 1..23: mol_type = other DNA
tcagttttcctggattatgcctg

SEQ ID NO: 17149 - DNA, 22 bp, synthetic construct
  source 1..22: mol_type = other DNA
cagttttcctggattatgcctg

SEQ ID NO: 17150 - DNA, 22 bp, synthetic construct
  source 1..22: mol_type = other DNA
tgctttgatgacgcttctgtat

SEQ ID NO: 17151 - DNA, 24 bp, synthetic construct
  source 1..24: mol_type = other DNA
tctcagttttcctggattatgcct

SEQ ID NO: 17152 - DNA, 20 bp, synthetic construct
  source 1..20: mol_type = other DNA
agttttcctggattatgcct

SEQ ID NO: 17153 - DNA, 20 bp, synthetic construct
  source 1..20: mol_type = other DNA
agttttcctggattatgcct

SEQ ID NO: 17154 - DNA, 20 bp, synthetic construct
  source 1..20: mol_type = other DNA
gctttgatgacgcttctgta

SEQ ID NO: 17155 - DNA, 23 bp, synthetic construct
  source 1..23: mol_type = other DNA
ctcagttttcctggattatgcct

SEQ ID NO: 17156 - DNA, 23 bp, synthetic construct
  source 1..23: mol_type = other DNA
ctcagttttcctggattatgcct

SEQ ID NO: 17157 - DNA, 20 bp, synthetic construct
  source 1..20: mol_type = other DNA
agttttcctggattatgcct

SEQ ID NO: 17158 - DNA, 20 bp, synthetic construct
  source 1..20: mol_type = other DNA
agttttcctggattatgcct

SEQ ID NO: 17159 - DNA, 20 bp, synthetic construct
  source 1..20: mol_type = other DNA
agttttcctggattatgcct

SEQ ID NO: 17160 - DNA, 20 bp, synthetic construct
  source 1..20: mol_type = other DNA
agttttcctggattatgcct

SEQ ID NO: 17161 - DNA, 20 bp, synthetic construct
  source 1..20: mol_type = other DNA
cagttttcctggattatgcc

SEQ ID NO: 17162 - DNA, 20 bp, synthetic construct
  source 1..20: mol_type = other DNA
cagttttcctggattatgcc

SEQ ID NO: 17163 - DNA, 20 bp, synthetic construct
  source 1..20: mol_type = other DNA
cagttttcctggattatgcc

SEQ ID NO: 17164 - DNA, 20 bp, synthetic construct
  source 1..20: mol_type = other DNA
cagttttcctggattatgcc

SEQ ID NO: 17165 - DNA, 20 bp, synthetic construct
  source 1..20: mol_type = other DNA
tgctttgatgacgcttctgt

SEQ ID NO: 17166 - DNA, 22 bp, synthetic construct
  source 1..22: mol_type = other DNA
ctcagttttcctggattatgcc

SEQ ID NO: 17167 - DNA, 20 bp, synthetic construct
  source 1..20: mol_type = other DNA
cagttttcctggattatgcc

SEQ ID NO: 17168 - DNA, 20 bp, synthetic construct
  source 1..20: mol_type = other DNA
cagttttcctggattatgcc

SEQ ID NO: 17169 - DNA, 20 bp, synthetic construct
  source 1..20: mol_type = other DNA
cagttttcctggattatgcc

SEQ ID NO: 17170 - DNA, 20 bp, synthetic construct
  source 1..20: mol_type = other DNA
cagttttcctggattatgcc

SEQ ID NO: 17171 - DNA, 20 bp, synthetic construct
  source 1..20: mol_type = other DNA
cagttttcctggattatgcc

SEQ ID NO: 17172 - DNA, 20 bp, synthetic construct
  source 1..20: mol_type = other DNA
cagttttcctggattatgcc

SEQ ID NO: 17173 - DNA, 20 bp, synthetic construct
  source 1..20: mol_type = other DNA
cagttttcctggattatgcc

SEQ ID NO: 17174 - DNA, 21 bp, synthetic construct
  source 1..21: mol_type = other DNA
ctcagttttcctggattatgc

SEQ ID NO: 17175 - DNA, 21 bp, synthetic construct
  source 1..21: mol_type = other DNA
ctcagttttcctggattatgc

SEQ ID NO: 17176 - DNA, 20 bp, synthetic construct
  source 1..20: mol_type = other DNA
tcagttttcctggattatgc

SEQ ID NO: 17177 - DNA, 20 bp, synthetic construct
  source 1..20: mol_type = other DNA
tcagttttcctggattatgc

SEQ ID NO: 17178 - DNA, 20 bp, synthetic construct
  source 1..20: mol_type = other DNA
atgctttgatgacgcttctg

SEQ ID NO: 17179 - DNA, 23 bp, synthetic construct
  source 1..23: mol_type = other DNA
ttctcagttttcctggattatgc

SEQ ID NO: 17180 - DNA, 20 bp, synthetic construct
  source 1..20: mol_type = other DNA
tcagttttcctggattatgc

SEQ ID NO: 17181 - DNA, 20 bp, synthetic construct
  source 1..20: mol_type = other DNA
tcagttttcctggattatgc

SEQ ID NO: 17182 - DNA, 20 bp, synthetic construct
  source 1..20: mol_type = other DNA
atgctttgatgacgcttctg

SEQ ID NO: 17183 - DNA, 21 bp, synthetic construct
  source 1..21: mol_type = other DNA
tctcagttttcctggattatg

SEQ ID NO: 17184 - DNA, 20 bp, synthetic construct
  source 1..20: mol_type = other DNA
ctcagttttcctggattatg

SEQ ID NO: 17185 - DNA, 20 bp, synthetic construct
  source 1..20: mol_type = other DNA
catgctttgatgacgcttct

SEQ ID NO: 17186 - DNA, 23 bp, synthetic construct
  source 1..23: mol_type = other DNA
tggcatgctttgatgacgcttct

SEQ ID NO: 17187 - DNA, 23 bp, synthetic construct
  source 1..23: mol_type = other DNA
tggcatgctttgatgacgcttct

SEQ ID NO: 17188 - DNA, 23 bp, synthetic construct
  source 1..23: mol_type = other DNA
gttctcagttttcctggattatg

SEQ ID NO: 17189 - DNA, 20 bp, synthetic construct
  source 1..20: mol_type = other DNA
gcatgctttgatgacgcttc

SEQ ID NO: 17190 - DNA, 20 bp, synthetic construct
  source 1..20: mol_type = other DNA
tctcagttttcctggattat

SEQ ID NO: 17191 - DNA, 20 bp, synthetic construct
  source 1..20: mol_type = other DNA
gcatgctttgatgacgcttc

SEQ ID NO: 17192 - DNA, 20 bp, synthetic construct
  source 1..20: mol_type = other DNA
gcatgctttgatgacgcttc

SEQ ID NO: 17193 - DNA, 20 bp, synthetic construct
  source 1..20: mol_type = other DNA
gcatgctttgatgacgcttc

SEQ ID NO: 17194 - DNA, 20 bp, synthetic construct
  source 1..20: mol_type = other DNA
gcatgctttgatgacgcttc

SEQ ID NO: 17195 - DNA, 20 bp, synthetic construct
  source 1..20: mol_type = other DNA
gcatgctttgatgacgcttc

SEQ ID NO: 17196 - DNA, 20 bp, synthetic construct
  source 1..20: mol_type = other DNA
ggcatgctttgatgacgctt

SEQ ID NO: 17197 - DNA, 20 bp, synthetic construct
  source 1..20: mol_type = other DNA
ttctcagttttcctggatta

SEQ ID NO: 17198 - DNA, 20 bp, synthetic construct
  source 1..20: mol_type = other DNA
ttctcagttttcctggatta

SEQ ID NO: 17199 - DNA, 20 bp, synthetic construct
  source 1..20: mol_type = other DNA
ggcatgctttgatgacgctt

SEQ ID NO: 17200 - DNA, 22 bp, synthetic construct
  source 1..22: mol_type = other DNA
ttggcatgctttgatgacgctt

SEQ ID NO: 17201 - DNA, 20 bp, synthetic construct
  source 1..20: mol_type = other DNA
ggcatgctttgatgacgctt

SEQ ID NO: 17202 - DNA, 20 bp, synthetic construct
  source 1..20: mol_type = other DNA
ggcatgctttgatgacgctt

SEQ ID NO: 17203 - DNA, 20 bp, synthetic construct
  source 1..20: mol_type = other DNA
ttctcagttttcctggatta

SEQ ID NO: 17204 - DNA, 20 bp, synthetic construct
  source 1..20: mol_type = other DNA
ttctcagttttcctggatta

SEQ ID NO: 17205 - DNA, 20 bp, synthetic construct
  source 1..20: mol_type = other DNA
ttctcagttttcctggatta

SEQ ID NO: 17206 - DNA, 20 bp, synthetic construct
  source 1..20: mol_type = other DNA
ttctcagttttcctggatta

SEQ ID NO: 17207 - DNA, 20 bp, synthetic construct
  source 1..20: mol_type = other DNA
gttctcagttttcctggatt

SEQ ID NO: 17208 - DNA, 20 bp, synthetic construct
  source 1..20: mol_type = other DNA
gttctcagttttcctggatt

SEQ ID NO: 17209 - DNA, 20 bp, synthetic construct
  source 1..20: mol_type = other DNA
tggcatgctttgatgacgct

SEQ ID NO: 17210 - DNA, 23 bp, synthetic construct
  source 1..23: mol_type = other DNA
tctgttctcagttttcctggatt

SEQ ID NO: 17211 - DNA, 23 bp, synthetic construct
  source 1..23: mol_type = other DNA
tctgttctcagttttcctggatt

SEQ ID NO: 17212 - DNA, 20 bp, synthetic construct
  source 1..20: mol_type = other DNA
gttctcagttttcctggatt

SEQ ID NO: 17213 - DNA, 20 bp, synthetic construct
  source 1..20: mol_type = other DNA
gttctcagttttcctggatt

SEQ ID NO: 17214 - DNA, 24 bp, synthetic construct
  source 1..24: mol_type = other DNA
attctgttctcagttttcctggat

SEQ ID NO: 17215 - DNA, 20 bp, synthetic construct
  source 1..20: mol_type = other DNA
tgttctcagttttcctggat

SEQ ID NO: 17216 - DNA, 20 bp, synthetic construct
  source 1..20: mol_type = other DNA
ttggcatgctttgatgacgc

SEQ ID NO: 17217 - DNA, 23 bp, synthetic construct
  source 1..23: mol_type = other DNA
ttctgttctcagttttcctggat

SEQ ID NO: 17218 - DNA, 23 bp, synthetic construct
  source 1..23: mol_type = other DNA
ttctgttctcagttttcctggat

SEQ ID NO: 17219 - DNA, 20 bp, synthetic construct
  source 1..20: mol_type = other DNA
ctgttctcagttttcctgga

SEQ ID NO: 17220 - DNA, 20 bp, synthetic construct
  source 1..20: mol_type = other DNA
gttggcatgctttgatgacg

SEQ ID NO: 17221 - DNA, 20 bp, synthetic construct
  source 1..20: mol_type = other DNA
tctgttctcagttttcctgg

SEQ ID NO: 17222 - DNA, 20 bp, synthetic construct
  source 1..20: mol_type = other DNA
agttggcatgctttgatgac

SEQ ID NO: 17223 - DNA, 23 bp, synthetic construct
  source 1..23: mol_type = other DNA
tctagttggcatgctttgatgac

SEQ ID NO: 17224 - DNA, 23 bp, synthetic construct
  source 1..23: mol_type = other DNA
tctagttggcatgctttgatgac

SEQ ID NO: 17225 - DNA, 20 bp, synthetic construct
  source 1..20: mol_type = other DNA
tagttggcatgctttgatga

SEQ ID NO: 17226 - DNA, 20 bp, synthetic construct
  source 1..20: mol_type = other DNA
ttctgttctcagttttcctg

SEQ ID NO: 17227 - DNA, 20 bp, synthetic construct
  source 1..20: mol_type = other DNA
tagttggcatgctttgatga

SEQ ID NO: 17228 - DNA, 20 bp, synthetic construct
  source 1..20: mol_type = other DNA
ttctgttctcagttttcctg

SEQ ID NO: 17229 - DNA, 20 bp, synthetic construct
  source 1..20: mol_type = other DNA
tagttggcatgctttgatga

SEQ ID NO: 17230 - DNA, 20 bp, synthetic construct
  source 1..20: mol_type = other DNA
tagttggcatgctttgatga

SEQ ID NO: 17231 - DNA, 20 bp, synthetic construct
  source 1..20: mol_type = other DNA
ttctgttctcagttttcctg

SEQ ID NO: 17232 - DNA, 20 bp, synthetic construct
  source 1..20: mol_type = other DNA
tagttggcatgctttgatga

SEQ ID NO: 17233 - DNA, 20 bp, synthetic construct
  source 1..20: mol_type = other DNA
tagttggcatgctttgatga

SEQ ID NO: 17234 - DNA, 20 bp, synthetic construct
  source 1..20: mol_type = other DNA
ctagttggcatgctttgatg

SEQ ID NO: 17235 - DNA, 20 bp, synthetic construct
  source 1..20: mol_type = other DNA
attctgttctcagttttcct

SEQ ID NO: 17236 - DNA, 20 bp, synthetic construct
  source 1..20: mol_type = other DNA
attctgttctcagttttcct

SEQ ID NO: 17237 - DNA, 20 bp, synthetic construct
  source 1..20: mol_type = other DNA
ctagttggcatgctttgatg

SEQ ID NO: 17238 - DNA, 22 bp, synthetic construct
  source 1..22: mol_type = other DNA
tcattctgttctcagttttcct

SEQ ID NO: 17239 - DNA, 22 bp, synthetic construct
  source 1..22: mol_type = other DNA
ttctagttggcatgctttgatg

SEQ ID NO: 17240 - DNA, 20 bp, synthetic construct
  source 1..20: mol_type = other DNA
ctagttggcatgctttgatg

SEQ ID NO: 17241 - DNA, 20 bp, synthetic construct
  source 1..20: mol_type = other DNA
ctagttggcatgctttgatg

SEQ ID NO: 17242 - DNA, 20 bp, synthetic construct
  source 1..20: mol_type = other DNA
attctgttctcagttttcct

SEQ ID NO: 17243 - DNA, 20 bp, synthetic construct
  source 1..20: mol_type = other DNA
attctgttctcagttttcct

SEQ ID NO: 17244 - DNA, 20 bp, synthetic construct
  source 1..20: mol_type = other DNA
attctgttctcagttttcct

SEQ ID NO: 17245 - DNA, 20 bp, synthetic construct
  source 1..20: mol_type = other DNA
attctgttctcagttttcct

SEQ ID NO: 17246 - DNA, 20 bp, synthetic construct
  source 1..20: mol_type = other DNA
attctgttctcagttttcct

SEQ ID NO: 17247 - DNA, 20 bp, synthetic construct
  source 1..20: mol_type = other DNA
cattctgttctcagttttcc

SEQ ID NO: 17248 - DNA, 20 bp, synthetic construct
  source 1..20: mol_type = other DNA
cattctgttctcagttttcc

SEQ ID NO: 17249 - DNA, 20 bp, synthetic construct
  source 1..20: mol_type = other DNA
cattctgttctcagttttcc

SEQ ID NO: 17250 - DNA, 20 bp, synthetic construct
  source 1..20: mol_type = other DNA
cattctgttctcagttttcc

SEQ ID NO: 17251 - DNA, 20 bp, synthetic construct
  source 1..20: mol_type = other DNA
tctagttggcatgctttgat

SEQ ID NO: 17252 - DNA, 23 bp, synthetic construct
  source 1..23: mol_type = other DNA
tcttctagttggcatgctttgat

SEQ ID NO: 17253 - DNA, 21 bp, synthetic construct
  source 1..21: mol_type = other DNA
tcattctgttctcagttttcc

SEQ ID NO: 17254 - DNA, 21 bp, synthetic construct
  source 1..21: mol_type = other DNA
ttctagttggcatgctttgat

SEQ ID NO: 17255 - DNA, 21 bp, synthetic construct
  source 1..21: mol_type = other DNA
tcattctgttctcagttttcc

SEQ ID NO: 17256 - DNA, 21 bp, synthetic construct
  source 1..21: mol_type = other DNA
ttctagttggcatgctttgat

SEQ ID NO: 17257 - DNA, 20 bp, synthetic construct
  source 1..20: mol_type = other DNA
cattctgttctcagttttcc

SEQ ID NO: 17258 - DNA, 20 bp, synthetic construct
  source 1..20: mol_type = other DNA
cattctgttctcagttttcc

SEQ ID NO: 17259 - DNA, 20 bp, synthetic construct
  source 1..20: mol_type = other DNA
cattctgttctcagttttcc

SEQ ID NO: 17260 - DNA, 20 bp, synthetic construct
  source 1..20: mol_type = other DNA
cattctgttctcagttttcc

SEQ ID NO: 17261 - DNA, 20 bp, synthetic construct
  source 1..20: mol_type = other DNA
cattctgttctcagttttcc

SEQ ID NO: 17262 - DNA, 20 bp, synthetic construct
  source 1..20: mol_type = other DNA
cattctgttctcagttttcc

SEQ ID NO: 17263 - DNA, 20 bp, synthetic construct
  source 1..20: mol_type = other DNA
cattctgttctcagttttcc

SEQ ID NO: 17264 - DNA, 24 bp, synthetic construct
  source 1..24: mol_type = other DNA
aatttcattctgttctcagttttc

SEQ ID NO: 17265 - DNA, 23 bp, synthetic construct
  source 1..23: mol_type = other DNA
atttcattctgttctcagttttc

SEQ ID NO: 17266 - DNA, 23 bp, synthetic construct
  source 1..23: mol_type = other DNA
atttcattctgttctcagttttc

SEQ ID NO: 17267 - DNA, 21 bp, synthetic construct
  source 1..21: mol_type = other DNA
ttcattctgttctcagttttc

SEQ ID NO: 17268 - DNA, 21 bp, synthetic construct
  source 1..21: mol_type = other DNA
ttcattctgttctcagttttc

SEQ ID NO: 17269 - DNA, 21 bp, synthetic construct
  source 1..21: mol_type = other DNA
ttcattctgttctcagttttc

SEQ ID NO: 17270 - DNA, 21 bp, synthetic construct
  source 1..21: mol_type = other DNA
ttcattctgttctcagttttc

SEQ ID NO: 17271 - DNA, 20 bp, synthetic construct
  source 1..20: mol_type = other DNA
tcattctgttctcagttttc

SEQ ID NO: 17272 - DNA, 20 bp, synthetic construct
  source 1..20: mol_type = other DNA
ttctagttggcatgctttga

SEQ ID NO: 17273 - DNA, 20 bp, synthetic construct
  source 1..20: mol_type = other DNA
tcattctgttctcagttttc

SEQ ID NO: 17274 - DNA, 20 bp, synthetic construct
  source 1..20: mol_type = other DNA
ttctagttggcatgctttga

SEQ ID NO: 17275 - DNA, 21 bp, synthetic construct
  source 1..21: mol_type = other DNA
ttcattctgttctcagttttc

SEQ ID NO: 17276 - DNA, 21 bp, synthetic construct
  source 1..21: mol_type = other DNA
ttcattctgttctcagttttc

SEQ ID NO: 17277 - DNA, 24 bp, synthetic construct
  source 1..24: mol_type = other DNA
cctcttctagttggcatgctttga

SEQ ID NO: 17278 - DNA, 20 bp, synthetic construct
  source 1..20: mol_type = other DNA
tcattctgttctcagttttc

SEQ ID NO: 17279 - DNA, 20 bp, synthetic construct
  source 1..20: mol_type = other DNA
tcattctgttctcagttttc

SEQ ID NO: 17280 - DNA, 20 bp, synthetic construct
  source 1..20: mol_type = other DNA
ttctagttggcatgctttga

SEQ ID NO: 17281 - DNA, 20 bp, synthetic construct
  source 1..20: mol_type = other DNA
ttctagttggcatgctttga

SEQ ID NO: 17282 - DNA, 20 bp, synthetic construct
  source 1..20: mol_type = other DNA
ttctagttggcatgctttga

SEQ ID NO: 17283 - DNA, 20 bp, synthetic construct
  source 1..20: mol_type = other DNA
ttctagttggcatgctttga

SEQ ID NO: 17284 - DNA, 20 bp, synthetic construct
  source 1..20: mol_type = other DNA
ttctagttggcatgctttga

SEQ ID NO: 17285 - DNA, 21 bp, synthetic construct
  source 1..21: mol_type = other DNA
tttcattctgttctcagtttt

SEQ ID NO: 17286 - DNA, 20 bp, synthetic construct
  source 1..20: mol_type = other DNA
cttctagttggcatgctttg

SEQ ID NO: 17287 - DNA, 20 bp, synthetic construct
  source 1..20: mol_type = other DNA
ttcattctgttctcagtttt

SEQ ID NO: 17288 - DNA, 20 bp, synthetic construct
  source 1..20: mol_type = other DNA
cttctagttggcatgctttg

SEQ ID NO: 17289 - DNA, 23 bp, synthetic construct
  source 1..23: mol_type = other DNA
cctcttctagttggcatgctttg

SEQ ID NO: 17290 - DNA, 24 bp, synthetic construct
  source 1..24: mol_type = other DNA
gaatttcattctgttctcagtttt

SEQ ID NO: 17291 - DNA, 20 bp, synthetic construct
  source 1..20: mol_type = other DNA
cttctagttggcatgctttg

SEQ ID NO: 17292 - DNA, 20 bp, synthetic construct
  source 1..20: mol_type = other DNA
cttctagttggcatgctttg

SEQ ID NO: 17293 - DNA, 21 bp, synthetic construct
  source 1..21: mol_type = other DNA
ctcttctagttggcatgcttt

SEQ ID NO: 17294 - DNA, 20 bp, synthetic construct
  source 1..20: mol_type = other DNA
tttcattctgttctcagttt

SEQ ID NO: 17295 - DNA, 20 bp, synthetic construct
  source 1..20: mol_type = other DNA
tcttctagttggcatgcttt

SEQ ID NO: 17296 - DNA, 20 bp, synthetic construct
  source 1..20: mol_type = other DNA
tcttctagttggcatgcttt

SEQ ID NO: 17297 - DNA, 20 bp, synthetic construct
  source 1..20: mol_type = other DNA
ctcttctagttggcatgctt

SEQ ID NO: 17298 - DNA, 20 bp, synthetic construct
  source 1..20: mol_type = other DNA
atttcattctgttctcagtt

SEQ ID NO: 17299 - DNA, 20 bp, synthetic construct
  source 1..20: mol_type = other DNA
ctcttctagttggcatgctt

SEQ ID NO: 17300 - DNA, 20 bp, synthetic construct
  source 1..20: mol_type = other DNA
ctcttctagttggcatgctt

SEQ ID NO: 17301 - DNA, 20 bp, synthetic construct
  source 1..20: mol_type = other DNA
ctcttctagttggcatgctt

SEQ ID NO: 17302 - DNA, 20 bp, synthetic construct
  source 1..20: mol_type = other DNA
ctcttctagttggcatgctt

SEQ ID NO: 17303 - DNA, 20 bp, synthetic construct
  source 1..20: mol_type = other DNA
ctcttctagttggcatgctt

SEQ ID NO: 17304 - DNA, 20 bp, synthetic construct
  source 1..20: mol_type = other DNA
ctcttctagttggcatgctt

SEQ ID NO: 17305 - DNA, 20 bp, synthetic construct
  source 1..20: mol_type = other DNA
cctcttctagttggcatgct

SEQ ID NO: 17306 - DNA, 20 bp, synthetic construct
  source 1..20: mol_type = other DNA
aatttcattctgttctcagt

SEQ ID NO: 17307 - DNA, 20 bp, synthetic construct
  source 1..20: mol_type = other DNA
cctcttctagttggcatgct

SEQ ID NO: 17308 - DNA, 23 bp, synthetic construct
  source 1..23: mol_type = other DNA
aagaatttcattctgttctcagt

SEQ ID NO: 17309 - DNA, 23 bp, synthetic construct
  source 1..23: mol_type = other DNA
aagaatttcattctgttctcagt

SEQ ID NO: 17310 - DNA, 21 bp, synthetic construct
  source 1..21: mol_type = other DNA
acctcttctagttggcatgct

SEQ ID NO: 17311 - DNA, 21 bp, synthetic construct
  source 1..21: mol_type = other DNA
acctcttctagttggcatgct

SEQ ID NO: 17312 - DNA, 20 bp, synthetic construct
  source 1..20: mol_type = other DNA
cctcttctagttggcatgct

SEQ ID NO: 17313 - DNA, 20 bp, synthetic construct
  source 1..20: mol_type = other DNA
cctcttctagttggcatgct

SEQ ID NO: 17314 - DNA, 24 bp, synthetic construct
  source 1..24: mol_type = other DNA
ggaagaatttcattctgttctcag

SEQ ID NO: 17315 - DNA, 21 bp, synthetic construct
  source 1..21: mol_type = other DNA
tacctcttctagttggcatgc

SEQ ID NO: 17316 - DNA, 21 bp, synthetic construct
  source 1..21: mol_type = other DNA
tacctcttctagttggcatgc

SEQ ID NO: 17317 - DNA, 20 bp, synthetic construct
  source 1..20: mol_type = other DNA
gaatttcattctgttctcag

SEQ ID NO: 17318 - DNA, 20 bp, synthetic construct
  source 1..20: mol_type = other DNA
acctcttctagttggcatgc

SEQ ID NO: 17319 - DNA, 23 bp, synthetic construct
  source 1..23: mol_type = other DNA
gaagaatttcattctgttctcag

SEQ ID NO: 17320 - DNA, 23 bp, synthetic construct
  source 1..23: mol_type = other DNA
gaagaatttcattctgttctcag

SEQ ID NO: 17321 - DNA, 20 bp, synthetic construct
  source 1..20: mol_type = other DNA
agaatttcattctgttctca

SEQ ID NO: 17322 - DNA, 20 bp, synthetic construct
  source 1..20: mol_type = other DNA
tacctcttctagttggcatg

SEQ ID NO: 17323 - DNA, 20 bp, synthetic construct
  source 1..20: mol_type = other DNA
aagaatttcattctgttctc

SEQ ID NO: 17324 - DNA, 20 bp, synthetic construct
  source 1..20: mol_type = other DNA
aagaatttcattctgttctc

SEQ ID NO: 17325 - DNA, 20 bp, synthetic construct
  source 1..20: mol_type = other DNA
ttacctcttctagttggcat

SEQ ID NO: 17326 - DNA, 20 bp, synthetic construct
  source 1..20: mol_type = other DNA
aagaatttcattctgttctc

SEQ ID NO: 17327 - DNA, 20 bp, synthetic construct
  source 1..20: mol_type = other DNA
aagaatttcattctgttctc

SEQ ID NO: 17328 - DNA, 20 bp, synthetic construct
  source 1..20: mol_type = other DNA
aagaatttcattctgttctc

SEQ ID NO: 17329 - DNA, 20 bp, synthetic construct
  source 1..20: mol_type = other DNA
aagaatttcattctgttctc

SEQ ID NO: 17330 - DNA, 20 bp, synthetic construct
  source 1..20: mol_type = other DNA
gaagaatttcattctgttct

SEQ ID NO: 17331 - DNA, 20 bp, synthetic construct
  source 1..20: mol_type = other DNA
cttacctcttctagttggca

SEQ ID NO: 17332 - DNA, 20 bp, synthetic construct
  source 1..20: mol_type = other DNA
gaagaatttcattctgttct

SEQ ID NO: 17333 - DNA, 20 bp, synthetic construct
  source 1..20: mol_type = other DNA
cttacctcttctagttggca

SEQ ID NO: 17334 - DNA, 22 bp, synthetic construct
  source 1..22: mol_type = other DNA
tggaagaatttcattctgttct

SEQ ID NO: 17335 - DNA, 20 bp, synthetic construct
  source 1..20: mol_type = other DNA
gaagaatttcattctgttct

SEQ ID NO: 17336 - DNA, 20 bp, synthetic construct
  source 1..20: mol_type = other DNA
gaagaatttcattctgttct

SEQ ID NO: 17337 - DNA, 20 bp, synthetic construct
  source 1..20: mol_type = other DNA
gaagaatttcattctgttct

SEQ ID NO: 17338 - DNA, 20 bp, synthetic construct
  source 1..20: mol_type = other DNA
cttacctcttctagttggca

SEQ ID NO: 17339 - DNA, 20 bp, synthetic construct
  source 1..20: mol_type = other DNA
cttacctcttctagttggca

SEQ ID NO: 17340 - DNA, 20 bp, synthetic construct
  source 1..20: mol_type = other DNA
cttacctcttctagttggca

SEQ ID NO: 17341 - DNA, 20 bp, synthetic construct
  source 1..20: mol_type = other DNA
cttacctcttctagttggca

SEQ ID NO: 17342 - DNA, 21 bp, synthetic construct
  source 1..21: mol_type = other DNA
tggaagaatttcattctgttc

SEQ ID NO: 17343 - DNA, 20 bp, synthetic construct
  source 1..20: mol_type = other DNA
tcttacctcttctagttggc

SEQ ID NO: 17344 - DNA, 20 bp, synthetic construct
  source 1..20: mol_type = other DNA
ggaagaatttcattctgttc

SEQ ID NO: 17345 - DNA, 20 bp, synthetic construct
  source 1..20: mol_type = other DNA
tcttacctcttctagttggc

SEQ ID NO: 17346 - DNA, 21 bp, synthetic construct
  source 1..21: mol_type = other DNA
tggaagaatttcattctgttc

SEQ ID NO: 17347 - DNA, 21 bp, synthetic construct
  source 1..21: mol_type = other DNA
tggaagaatttcattctgttc

SEQ ID NO: 17348 - DNA, 22 bp, synthetic construct
  source 1..22: mol_type = other DNA
tttcttacctcttctagttggc

SEQ ID NO: 17349 - DNA, 20 bp, synthetic construct
  source 1..20: mol_type = other DNA
tcttacctcttctagttggc

SEQ ID NO: 17350 - DNA, 20 bp, synthetic construct
  source 1..20: mol_type = other DNA
tcttacctcttctagttggc

SEQ ID NO: 17351 - DNA, 24 bp, synthetic construct
  source 1..24: mol_type = other DNA
acagtggaagaatttcattctgtt

SEQ ID NO: 17352 - DNA, 21 bp, synthetic construct
  source 1..21: mol_type = other DNA
gtggaagaatttcattctgtt

SEQ ID NO: 17353 - DNA, 21 bp, synthetic construct
  source 1..21: mol_type = other DNA
gtggaagaatttcattctgtt

SEQ ID NO: 17354 - DNA, 20 bp, synthetic construct
  source 1..20: mol_type = other DNA
tggaagaatttcattctgtt

SEQ ID NO: 17355 - DNA, 20 bp, synthetic construct
  source 1..20: mol_type = other DNA
ttcttacctcttctagttgg

SEQ ID NO: 17356 - DNA, 23 bp, synthetic construct
  source 1..23: mol_type = other DNA
agtttcttacctcttctagttgg

SEQ ID NO: 17357 - DNA, 23 bp, synthetic construct
  source 1..23: mol_type = other DNA
agtttcttacctcttctagttgg

SEQ ID NO: 17358 - DNA, 21 bp, synthetic construct
  source 1..21: mol_type = other DNA
gtggaagaatttcattctgtt

SEQ ID NO: 17359 - DNA, 21 bp, synthetic construct
  source 1..21: mol_type = other DNA
gtggaagaatttcattctgtt

SEQ ID NO: 17360 - DNA, 24 bp, synthetic construct
  source 1..24: mol_type = other DNA
acagtggaagaatttcattctgtt

SEQ ID NO: 17361 - DNA, 20 bp, synthetic construct
  source 1..20: mol_type = other DNA
gtggaagaatttcattctgt

SEQ ID NO: 17362 - DNA, 20 bp, synthetic construct
  source 1..20: mol_type = other DNA
tttcttacctcttctagttg

SEQ ID NO: 17363 - DNA, 24 bp, synthetic construct
  source 1..24: mol_type = other DNA
atagtttcttacctcttctagttg

SEQ ID NO: 17364 - DNA, 20 bp, synthetic construct
  source 1..20: mol_type = other DNA
gtttcttacctcttctagtt

SEQ ID NO: 17365 - DNA, 20 bp, synthetic construct
  source 1..20: mol_type = other DNA
agtggaagaatttcattctg

SEQ ID NO: 17366 - DNA, 20 bp, synthetic construct
  source 1..20: mol_type = other DNA
gtttcttacctcttctagtt

SEQ ID NO: 17367 - DNA, 23 bp, synthetic construct
  source 1..23: mol_type = other DNA
cacagtggaagaatttcattctg

SEQ ID NO: 17368 - DNA, 23 bp, synthetic construct
  source 1..23: mol_type = other DNA
cacagtggaagaatttcattctg

SEQ ID NO: 17369 - DNA, 21 bp, synthetic construct
  source 1..21: mol_type = other DNA
agtttcttacctcttctagtt

SEQ ID NO: 17370 - DNA, 21 bp, synthetic construct
  source 1..21: mol_type = other DNA
agtttcttacctcttctagtt

SEQ ID NO: 17371 - DNA, 20 bp, synthetic construct
  source 1..20: mol_type = other DNA
gtttcttacctcttctagtt

SEQ ID NO: 17372 - DNA, 20 bp, synthetic construct
  source 1..20: mol_type = other DNA
gtttcttacctcttctagtt

SEQ ID NO: 17373 - DNA, 20 bp, synthetic construct
  source 1..20: mol_type = other DNA
gtttcttacctcttctagtt

SEQ ID NO: 17374 - DNA, 20 bp, synthetic construct
  source 1..20: mol_type = other DNA
gtttcttacctcttctagtt

SEQ ID NO: 17375 - DNA, 20 bp, synthetic construct
  source 1..20: mol_type = other DNA
agtttcttacctcttctagt

SEQ ID NO: 17376 - DNA, 20 bp, synthetic construct
  source 1..20: mol_type = other DNA
agtttcttacctcttctagt

SEQ ID NO: 17377 - DNA, 20 bp, synthetic construct
  source 1..20: mol_type = other DNA
agtttcttacctcttctagt

SEQ ID NO: 17378 - DNA, 20 bp, synthetic construct
  source 1..20: mol_type = other DNA
cagtggaagaatttcattct

SEQ ID NO: 17379 - DNA, 20 bp, synthetic construct
  source 1..20: mol_type = other DNA
agtttcttacctcttctagt

SEQ ID NO: 17380 - DNA, 20 bp, synthetic construct
  source 1..20: mol_type = other DNA
agtttcttacctcttctagt

SEQ ID NO: 17381 - DNA, 20 bp, synthetic construct
  source 1..20: mol_type = other DNA
agtttcttacctcttctagt

SEQ ID NO: 17382 - DNA, 20 bp, synthetic construct
  source 1..20: mol_type = other DNA
agtttcttacctcttctagt

SEQ ID NO: 17383 - DNA, 20 bp, synthetic construct
  source 1..20: mol_type = other DNA
agtttcttacctcttctagt

SEQ ID NO: 17384 - DNA, 20 bp, synthetic construct
  source 1..20: mol_type = other DNA
agtttcttacctcttctagt

SEQ ID NO: 17385 - DNA, 20 bp, synthetic construct
  source 1..20: mol_type = other DNA
agtttcttacctcttctagt

SEQ ID NO: 17386 - DNA, 20 bp, synthetic construct
  source 1..20: mol_type = other DNA
agtttcttacctcttctagt

SEQ ID NO: 17387 - DNA, 21 bp, synthetic construct
  source 1..21: mol_type = other DNA
atagtttcttacctcttctag

SEQ ID NO: 17388 - DNA, 21 bp, synthetic construct
  source 1..21: mol_type = other DNA
atagtttcttacctcttctag

SEQ ID NO: 17389 - DNA, 20 bp, synthetic construct
  source 1..20: mol_type = other DNA
tagtttcttacctcttctag

SEQ ID NO: 17390 - DNA, 20 bp, synthetic construct
  source 1..20: mol_type = other DNA
acagtggaagaatttcattc

SEQ ID NO: 17391 - DNA, 20 bp, synthetic construct
  source 1..20: mol_type = other DNA
acagtggaagaatttcattc

SEQ ID NO: 17392 - DNA, 20 bp, synthetic construct
  source 1..20: mol_type = other DNA
tagtttcttacctcttctag

SEQ ID NO: 17393 - DNA, 23 bp, synthetic construct
  source 1..23: mol_type = other DNA
agcacagtggaagaatttcattc

SEQ ID NO: 17394 - DNA, 23 bp, synthetic construct
  source 1..23: mol_type = other DNA
acatagtttcttacctcttctag

SEQ ID NO: 17395 - DNA, 23 bp, synthetic construct
  source 1..23: mol_type = other DNA
acatagtttcttacctcttctag

SEQ ID NO: 17396 - DNA, 20 bp, synthetic construct
  source 1..20: mol_type = other DNA
tagtttcttacctcttctag

SEQ ID NO: 17397 - DNA, 20 bp, synthetic construct
  source 1..20: mol_type = other DNA
tagtttcttacctcttctag

SEQ ID NO: 17398 - DNA, 20 bp, synthetic construct
  source 1..20: mol_type = other DNA
acagtggaagaatttcattc

SEQ ID NO: 17399 - DNA, 20 bp, synthetic construct
  source 1..20: mol_type = other DNA
acagtggaagaatttcattc

SEQ ID NO: 17400 - DNA, 20 bp, synthetic construct
  source 1..20: mol_type = other DNA
acagtggaagaatttcattc

SEQ ID NO: 17401 - DNA, 20 bp, synthetic construct
  source 1..20: mol_type = other DNA
acagtggaagaatttcattc

SEQ ID NO: 17402 - DNA, 21 bp, synthetic construct
  source 1..21: mol_type = other DNA
catagtttcttacctcttcta

SEQ ID NO: 17403 - DNA, 20 bp, synthetic construct
  source 1..20: mol_type = other DNA
cacagtggaagaatttcatt

SEQ ID NO: 17404 - DNA, 20 bp, synthetic construct
  source 1..20: mol_type = other DNA
cacagtggaagaatttcatt

SEQ ID NO: 17405 - DNA, 20 bp, synthetic construct
  source 1..20: mol_type = other DNA
atagtttcttacctcttcta

SEQ ID NO: 17406 - DNA, 22 bp, synthetic construct
  source 1..22: mol_type = other DNA
agcacagtggaagaatttcatt

SEQ ID NO: 17407 - DNA, 20 bp, synthetic construct
  source 1..20: mol_type = other DNA
cacagtggaagaatttcatt

SEQ ID NO: 17408 - DNA, 20 bp, synthetic construct
  source 1..20: mol_type = other DNA
cacagtggaagaatttcatt

SEQ ID NO: 17409 - DNA, 20 bp, synthetic construct
  source 1..20: mol_type = other DNA
catagtttcttacctcttct

SEQ ID NO: 17410 - DNA, 20 bp, synthetic construct
  source 1..20: mol_type = other DNA
gcacagtggaagaatttcat

SEQ ID NO: 17411 - DNA, 20 bp, synthetic construct
  source 1..20: mol_type = other DNA
catagtttcttacctcttct

SEQ ID NO: 17412 - DNA, 20 bp, synthetic construct
  source 1..20: mol_type = other DNA
catagtttcttacctcttct

SEQ ID NO: 17413 - DNA, 20 bp, synthetic construct
  source 1..20: mol_type = other DNA
catagtttcttacctcttct

SEQ ID NO: 17414 - DNA, 20 bp, synthetic construct
  source 1..20: mol_type = other DNA
catagtttcttacctcttct

SEQ ID NO: 17415 - DNA, 20 bp, synthetic construct
  source 1..20: mol_type = other DNA
catagtttcttacctcttct

SEQ ID NO: 17416 - DNA, 24 bp, synthetic construct
  source 1..24: mol_type = other DNA
attaagcacagtggaagaatttca

SEQ ID NO: 17417 - DNA, 20 bp, synthetic construct
  source 1..20: mol_type = other DNA
acatagtttcttacctcttc

SEQ ID NO: 17418 - DNA, 20 bp, synthetic construct
  source 1..20: mol_type = other DNA
agcacagtggaagaatttca

SEQ ID NO: 17419 - DNA, 20 bp, synthetic construct
  source 1..20: mol_type = other DNA
acatagtttcttacctcttc

SEQ ID NO: 17420 - DNA, 20 bp, synthetic construct
  source 1..20: mol_type = other DNA
acatagtttcttacctcttc

SEQ ID NO: 17421 - DNA, 20 bp, synthetic construct
  source 1..20: mol_type = other DNA
acatagtttcttacctcttc

SEQ ID NO: 17422 - DNA, 20 bp, synthetic construct
  source 1..20: mol_type = other DNA
acatagtttcttacctcttc

SEQ ID NO: 17423 - DNA, 21 bp, synthetic construct
  source 1..21: mol_type = other DNA
tcacatagtttcttacctctt

SEQ ID NO: 17424 - DNA, 20 bp, synthetic construct
  source 1..20: mol_type = other DNA
aagcacagtggaagaatttc

SEQ ID NO: 17425 - DNA, 20 bp, synthetic construct
  source 1..20: mol_type = other DNA
cacatagtttcttacctctt

SEQ ID NO: 17426 - DNA, 21 bp, synthetic construct
  source 1..21: mol_type = other DNA
tcacatagtttcttacctctt

SEQ ID NO: 17427 - DNA, 21 bp, synthetic construct
  source 1..21: mol_type = other DNA
tcacatagtttcttacctctt

SEQ ID NO: 17428 - DNA, 24 bp, synthetic construct
  source 1..24: mol_type = other DNA
gttttcacatagtttcttacctct

SEQ ID NO: 17429 - DNA, 21 bp, synthetic construct
  source 1..21: mol_type = other DNA
ttcacatagtttcttacctct

SEQ ID NO: 17430 - DNA, 21 bp, synthetic construct
  source 1..21: mol_type = other DNA
ttcacatagtttcttacctct

SEQ ID NO: 17431 - DNA, 20 bp, synthetic construct
  source 1..20: mol_type = other DNA
taagcacagtggaagaattt

SEQ ID NO: 17432 - DNA, 20 bp, synthetic construct
  source 1..20: mol_type = other DNA
tcacatagtttcttacctct

SEQ ID NO: 17433 - DNA, 23 bp, synthetic construct
  source 1..23: mol_type = other DNA
aattaagcacagtggaagaattt

SEQ ID NO: 17434 - DNA, 23 bp, synthetic construct
  source 1..23: mol_type = other DNA
aattaagcacagtggaagaattt

SEQ ID NO: 17435 - DNA, 20 bp, synthetic construct
  source 1..20: mol_type = other DNA
taagcacagtggaagaattt

SEQ ID NO: 17436 - DNA, 20 bp, synthetic construct
  source 1..20: mol_type = other DNA
ttaagcacagtggaagaatt

SEQ ID NO: 17437 - DNA, 20 bp, synthetic construct
  source 1..20: mol_type = other DNA
ttcacatagtttcttacctc

SEQ ID NO: 17438 - DNA, 22 bp, synthetic construct
  source 1..22: mol_type = other DNA
aattaagcacagtggaagaatt

SEQ ID NO: 17439 - DNA, 20 bp, synthetic construct
  source 1..20: mol_type = other DNA
attaagcacagtggaagaat

SEQ ID NO: 17440 - DNA, 20 bp, synthetic construct
  source 1..20: mol_type = other DNA
tttcacatagtttcttacct

SEQ ID NO: 17441 - DNA, 21 bp, synthetic construct
  source 1..21: mol_type = other DNA
aattaagcacagtggaagaat

SEQ ID NO: 17442 - DNA, 21 bp, synthetic construct
  source 1..21: mol_type = other DNA
aattaagcacagtggaagaat

SEQ ID NO: 17443 - DNA, 24 bp, synthetic construct
  source 1..24: mol_type = other DNA
gtaaaattaagcacagtggaagaa

SEQ ID NO: 17444 - DNA, 20 bp, synthetic construct
  source 1..20: mol_type = other DNA
aattaagcacagtggaagaa

SEQ ID NO: 17445 - DNA, 20 bp, synthetic construct
  source 1..20: mol_type = other DNA
ttttcacatagtttcttacc

SEQ ID NO: 17446 - DNA, 23 bp, synthetic construct
  source 1..23: mol_type = other DNA
aagttttcacatagtttcttacc

SEQ ID NO: 17447 - DNA, 23 bp, synthetic construct
  source 1..23: mol_type = other DNA
aagttttcacatagtttcttacc

SEQ ID NO: 17448 - DNA, 20 bp, synthetic construct
  source 1..20: mol_type = other DNA
aaattaagcacagtggaaga

SEQ ID NO: 17449 - DNA, 20 bp, synthetic construct
  source 1..20: mol_type = other DNA
gttttcacatagtttcttac

SEQ ID NO: 17450 - DNA, 23 bp, synthetic construct
  source 1..23: mol_type = other DNA
gtaaaattaagcacagtggaaga

SEQ ID NO: 17451 - DNA, 23 bp, synthetic construct
  source 1..23: mol_type = other DNA
gtaaaattaagcacagtggaaga

SEQ ID NO: 17452 - DNA, 20 bp, synthetic construct
  source 1..20: mol_type = other DNA
aaaattaagcacagtggaag

SEQ ID NO: 17453 - DNA, 20 bp, synthetic construct
  source 1..20: mol_type = other DNA
agttttcacatagtttctta

SEQ ID NO: 17454 - DNA, 20 bp, synthetic construct
  source 1..20: mol_type = other DNA
aaaattaagcacagtggaag

SEQ ID NO: 17455 - DNA, 20 bp, synthetic construct
  source 1..20: mol_type = other DNA
taaaattaagcacagtggaa

SEQ ID NO: 17456 - DNA, 20 bp, synthetic construct
  source 1..20: mol_type = other DNA
aagttttcacatagtttctt

SEQ ID NO: 17457 - DNA, 23 bp, synthetic construct
  source 1..23: mol_type = other DNA
aaaaagttttcacatagtttctt

SEQ ID NO: 17458 - DNA, 22 bp, synthetic construct
  source 1..22: mol_type = other DNA
ggtaaaattaagcacagtggaa

SEQ ID NO: 17459 - DNA, 21 bp, synthetic construct
  source 1..21: mol_type = other DNA
gtaaaattaagcacagtggaa

SEQ ID NO: 17460 - DNA, 20 bp, synthetic construct
  source 1..20: mol_type = other DNA
taaaattaagcacagtggaa

SEQ ID NO: 17461 - DNA, 20 bp, synthetic construct
  source 1..20: mol_type = other DNA
taaaattaagcacagtggaa

SEQ ID NO: 17462 - DNA, 20 bp, synthetic construct
  source 1..20: mol_type = other DNA
gtaaaattaagcacagtgga

SEQ ID NO: 17463 - DNA, 20 bp, synthetic construct
  source 1..20: mol_type = other DNA
gtaaaattaagcacagtgga

SEQ ID NO: 17464 - DNA, 20 bp, synthetic construct
  source 1..20: mol_type = other DNA
aaagttttcacatagtttct

SEQ ID NO: 17465 - DNA, 21 bp, synthetic construct
  source 1..21: mol_type = other DNA
ggtaaaattaagcacagtgga

SEQ ID NO: 17466 - DNA, 21 bp, synthetic construct
  source 1..21: mol_type = other DNA
ggtaaaattaagcacagtgga

SEQ ID NO: 17467 - DNA, 22 bp, synthetic construct
  source 1..22: mol_type = other DNA
gggtaaaattaagcacagtgga

SEQ ID NO: 17468 - DNA, 20 bp, synthetic construct
  source 1..20: mol_type = other DNA
gtaaaattaagcacagtgga

SEQ ID NO: 17469 - DNA, 20 bp, synthetic construct
  source 1..20: mol_type = other DNA
aaagttttcacatagtttct

SEQ ID NO: 17470 - DNA, 20 bp, synthetic construct
  source 1..20: mol_type = other DNA
gtaaaattaagcacagtgga

SEQ ID NO: 17471 - DNA, 20 bp, synthetic construct
  source 1..20: mol_type = other DNA
gtaaaattaagcacagtgga

SEQ ID NO: 17472 - DNA, 20 bp, synthetic construct
  source 1..20: mol_type = other DNA
gtaaaattaagcacagtgga

SEQ ID NO: 17473 - DNA, 20 bp, synthetic construct
  source 1..20: mol_type = other DNA
gtaaaattaagcacagtgga

SEQ ID NO: 17474 - DNA, 24 bp, synthetic construct
  source 1..24: mol_type = other DNA
agagggtaaaattaagcacagtgg

SEQ ID NO: 17475 - DNA, 23 bp, synthetic construct
  source 1..23: mol_type = other DNA
gagggtaaaattaagcacagtgg

SEQ ID NO: 17476 - DNA, 23 bp, synthetic construct
  source 1..23: mol_type = other DNA
gagggtaaaattaagcacagtgg

SEQ ID NO: 17477 - DNA, 21 bp, synthetic construct
  source 1..21: mol_type = other DNA
gggtaaaattaagcacagtgg

SEQ ID NO: 17478 - DNA, 21 bp, synthetic construct
  source 1..21: mol_type = other DNA
gggtaaaattaagcacagtgg

SEQ ID NO: 17479 - DNA, 20 bp, synthetic construct
  source 1..20: mol_type = other DNA
ggtaaaattaagcacagtgg

SEQ ID NO: 17480 - DNA, 20 bp, synthetic construct
  source 1..20: mol_type = other DNA
ggtaaaattaagcacagtgg

SEQ ID NO: 17481 - DNA, 20 bp, synthetic construct
  source 1..20: mol_type = other DNA
aaaagttttcacatagtttc

SEQ ID NO: 17482 - DNA, 23 bp, synthetic construct
  source 1..23: mol_type = other DNA
tcaaaaagttttcacatagtttc

SEQ ID NO: 17483 - DNA, 21 bp, synthetic construct
  source 1..21: mol_type = other DNA
gggtaaaattaagcacagtgg

SEQ ID NO: 17484 - DNA, 21 bp, synthetic construct
  source 1..21: mol_type = other DNA
gggtaaaattaagcacagtgg

SEQ ID NO: 17485 - DNA, 22 bp, synthetic construct
  source 1..22: mol_type = other DNA
agggtaaaattaagcacagtgg

SEQ ID NO: 17486 - DNA, 22 bp, synthetic construct
  source 1..22: mol_type = other DNA
caaaaagttttcacatagtttc

SEQ ID NO: 17487 - DNA, 20 bp, synthetic construct
  source 1..20: mol_type = other DNA
ggtaaaattaagcacagtgg

SEQ ID NO: 17488 - DNA, 20 bp, synthetic construct
  source 1..20: mol_type = other DNA
ggtaaaattaagcacagtgg

SEQ ID NO: 17489 - DNA, 20 bp, synthetic construct
  source 1..20: mol_type = other DNA
ggtaaaattaagcacagtgg

SEQ ID NO: 17490 - DNA, 24 bp, synthetic construct
  source 1..24: mol_type = other DNA
aatcaaaaagttttcacatagttt

SEQ ID NO: 17491 - DNA, 21 bp, synthetic construct
  source 1..21: mol_type = other DNA
agggtaaaattaagcacagtg

SEQ ID NO: 17492 - DNA, 21 bp, synthetic construct
  source 1..21: mol_type = other DNA
agggtaaaattaagcacagtg

SEQ ID NO: 17493 - DNA, 20 bp, synthetic construct
  source 1..20: mol_type = other DNA
gggtaaaattaagcacagtg

SEQ ID NO: 17494 - DNA, 20 bp, synthetic construct
  source 1..20: mol_type = other DNA
aaaaagttttcacatagttt

SEQ ID NO: 17495 - DNA, 20 bp, synthetic construct
  source 1..20: mol_type = other DNA
gggtaaaattaagcacagtg

SEQ ID NO: 17496 - DNA, 23 bp, synthetic construct
  source 1..23: mol_type = other DNA
atcaaaaagttttcacatagttt

SEQ ID NO: 17497 - DNA, 21 bp, synthetic construct
  source 1..21: mol_type = other DNA
agggtaaaattaagcacagtg

SEQ ID NO: 17498 - DNA, 21 bp, synthetic construct
  source 1..21: mol_type = other DNA
agggtaaaattaagcacagtg

SEQ ID NO: 17499 - DNA, 21 bp, synthetic construct
  source 1..21: mol_type = other DNA
agggtaaaattaagcacagtg

SEQ ID NO: 17500 - DNA, 20 bp, synthetic construct
  source 1..20: mol_type = other DNA
gggtaaaattaagcacagtg

SEQ ID NO: 17501 - DNA, 20 bp, synthetic construct
  source 1..20: mol_type = other DNA
gggtaaaattaagcacagtg

SEQ ID NO: 17502 - DNA, 21 bp, synthetic construct
  source 1..21: mol_type = other DNA
gagggtaaaattaagcacagt

SEQ ID NO: 17503 - DNA, 20 bp, synthetic construct
  source 1..20: mol_type = other DNA
agggtaaaattaagcacagt

SEQ ID NO: 17504 - DNA, 20 bp, synthetic construct
  source 1..20: mol_type = other DNA
agggtaaaattaagcacagt

SEQ ID NO: 17505 - DNA, 20 bp, synthetic construct
  source 1..20: mol_type = other DNA
caaaaagttttcacatagtt

SEQ ID NO: 17506 - DNA, 21 bp, synthetic construct
  source 1..21: mol_type = other DNA
gagggtaaaattaagcacagt

SEQ ID NO: 17507 - DNA, 21 bp, synthetic construct
  source 1..21: mol_type = other DNA
gagggtaaaattaagcacagt

SEQ ID NO: 17508 - DNA, 20 bp, synthetic construct
  source 1..20: mol_type = other DNA
agggtaaaattaagcacagt

SEQ ID NO: 17509 - DNA, 20 bp, synthetic construct
  source 1..20: mol_type = other DNA
agggtaaaattaagcacagt

SEQ ID NO: 17510 - DNA, 20 bp, synthetic construct
  source 1..20: mol_type = other DNA
agggtaaaattaagcacagt

SEQ ID NO: 17511 - DNA, 20 bp, synthetic construct
  source 1..20: mol_type = other DNA
agggtaaaattaagcacagt

SEQ ID NO: 17512 - DNA, 20 bp, synthetic construct
  source 1..20: mol_type = other DNA
agggtaaaattaagcacagt

SEQ ID NO: 17513 - DNA, 23 bp, synthetic construct
  source 1..23: mol_type = other DNA
tcagagggtaaaattaagcacag

SEQ ID NO: 17514 - DNA, 21 bp, synthetic construct
  source 1..21: mol_type = other DNA
agagggtaaaattaagcacag

SEQ ID NO: 17515 - DNA, 20 bp, synthetic construct
  source 1..20: mol_type = other DNA
gagggtaaaattaagcacag

SEQ ID NO: 17516 - DNA, 20 bp, synthetic construct
  source 1..20: mol_type = other DNA
gagggtaaaattaagcacag

SEQ ID NO: 17517 - DNA, 20 bp, synthetic construct
  source 1..20: mol_type = other DNA
gagggtaaaattaagcacag

SEQ ID NO: 17518 - DNA, 20 bp, synthetic construct
  source 1..20: mol_type = other DNA
gagggtaaaattaagcacag

SEQ ID NO: 17519 - DNA, 20 bp, synthetic construct
  source 1..20: mol_type = other DNA
tcaaaaagttttcacatagt

SEQ ID NO: 17520 - DNA, 21 bp, synthetic construct
  source 1..21: mol_type = other DNA
agagggtaaaattaagcacag

SEQ ID NO: 17521 - DNA, 21 bp, synthetic construct
  source 1..21: mol_type = other DNA
agagggtaaaattaagcacag

SEQ ID NO: 17522 - DNA, 20 bp, synthetic construct
  source 1..20: mol_type = other DNA
gagggtaaaattaagcacag

SEQ ID NO: 17523 - DNA, 20 bp, synthetic construct
  source 1..20: mol_type = other DNA
gagggtaaaattaagcacag

SEQ ID NO: 17524 - DNA, 20 bp, synthetic construct
  source 1..20: mol_type = other DNA
gagggtaaaattaagcacag

SEQ ID NO: 17525 - DNA, 20 bp, synthetic construct
  source 1..20: mol_type = other DNA
gagggtaaaattaagcacag

SEQ ID NO: 17526 - DNA, 20 bp, synthetic construct
  source 1..20: mol_type = other DNA
gagggtaaaattaagcacag

SEQ ID NO: 17527 - DNA, 20 bp, synthetic construct
  source 1..20: mol_type = other DNA
gagggtaaaattaagcacag

SEQ ID NO: 17528 - DNA, 20 bp, synthetic construct
  source 1..20: mol_type = other DNA
gagggtaaaattaagcacag

SEQ ID NO: 17529 - DNA, 23 bp, synthetic construct
  source 1..23: mol_type = other DNA
ttcagagggtaaaattaagcaca

SEQ ID NO: 17530 - DNA, 21 bp, synthetic construct
  source 1..21: mol_type = other DNA
cagagggtaaaattaagcaca

SEQ ID NO: 17531 - DNA, 21 bp, synthetic construct
  source 1..21: mol_type = other DNA
cagagggtaaaattaagcaca

SEQ ID NO: 17532 - DNA, 21 bp, synthetic construct
  source 1..21: mol_type = other DNA
cagagggtaaaattaagcaca

SEQ ID NO: 17533 - DNA, 20 bp, synthetic construct
  source 1..20: mol_type = other DNA
agagggtaaaattaagcaca

SEQ ID NO: 17534 - DNA, 20 bp, synthetic construct
  source 1..20: mol_type = other DNA
agagggtaaaattaagcaca

SEQ ID NO: 17535 - DNA, 20 bp, synthetic construct
  source 1..20: mol_type = other DNA
atcaaaaagttttcacatag

SEQ ID NO: 17536 - DNA, 21 bp, synthetic construct
  source 1..21: mol_type = other DNA
cagagggtaaaattaagcaca

SEQ ID NO: 17537 - DNA, 21 bp, synthetic construct
  source 1..21: mol_type = other DNA
cagagggtaaaattaagcaca

SEQ ID NO: 17538 - DNA, 20 bp, synthetic construct
  source 1..20: mol_type = other DNA
agagggtaaaattaagcaca

SEQ ID NO: 17539 - DNA, 20 bp, synthetic construct
  source 1..20: mol_type = other DNA
agagggtaaaattaagcaca

SEQ ID NO: 17540 - DNA, 21 bp, synthetic construct
  source 1..21: mol_type = other DNA
tcagagggtaaaattaagcac

SEQ ID NO: 17541 - DNA, 20 bp, synthetic construct
  source 1..20: mol_type = other DNA
cagagggtaaaattaagcac

SEQ ID NO: 17542 - DNA, 20 bp, synthetic construct
  source 1..20: mol_type = other DNA
cagagggtaaaattaagcac

SEQ ID NO: 17543 - DNA, 20 bp, synthetic construct
  source 1..20: mol_type = other DNA
aatcaaaaagttttcacata

SEQ ID NO: 17544 - DNA, 23 bp, synthetic construct
  source 1..23: mol_type = other DNA
cataatcaaaaagttttcacata

SEQ ID NO: 17545 - DNA, 23 bp, synthetic construct
  source 1..23: mol_type = other DNA
cataatcaaaaagttttcacata

SEQ ID NO: 17546 - DNA, 20 bp, synthetic construct
  source 1..20: mol_type = other DNA
cagagggtaaaattaagcac

SEQ ID NO: 17547 - DNA, 20 bp, synthetic construct
  source 1..20: mol_type = other DNA
cagagggtaaaattaagcac

SEQ ID NO: 17548 - DNA, 20 bp, synthetic construct
  source 1..20: mol_type = other DNA
cagagggtaaaattaagcac

SEQ ID NO: 17549 - DNA, 20 bp, synthetic construct
  source 1..20: mol_type = other DNA
tcagagggtaaaattaagca

SEQ ID NO: 17550 - DNA, 20 bp, synthetic construct
  source 1..20: mol_type = other DNA
taatcaaaaagttttcacat

SEQ ID NO: 17551 - DNA, 20 bp, synthetic construct
  source 1..20: mol_type = other DNA
tcagagggtaaaattaagca

SEQ ID NO: 17552 - DNA, 20 bp, synthetic construct
  source 1..20: mol_type = other DNA
taatcaaaaagttttcacat

SEQ ID NO: 17553 - DNA, 20 bp, synthetic construct
  source 1..20: mol_type = other DNA
tcagagggtaaaattaagca

SEQ ID NO: 17554 - DNA, 20 bp, synthetic construct
  source 1..20: mol_type = other DNA
tcagagggtaaaattaagca

SEQ ID NO: 17555 - DNA, 20 bp, synthetic construct
  source 1..20: mol_type = other DNA
tcagagggtaaaattaagca

SEQ ID NO: 17556 - DNA, 20 bp, synthetic construct
  source 1..20: mol_type = other DNA
taatcaaaaagttttcacat

SEQ ID NO: 17557 - DNA, 20 bp, synthetic construct
  source 1..20: mol_type = other DNA
taatcaaaaagttttcacat

SEQ ID NO: 17558 - DNA, 20 bp, synthetic construct
  source 1..20: mol_type = other DNA
taatcaaaaagttttcacat

SEQ ID NO: 17559 - DNA, 20 bp, synthetic construct
  source 1..20: mol_type = other DNA
taatcaaaaagttttcacat

SEQ ID NO: 17560 - DNA, 21 bp, synthetic construct
  source 1..21: mol_type = other DNA
cttcagagggtaaaattaagc

SEQ ID NO: 17561 - DNA, 20 bp, synthetic construct
  source 1..20: mol_type = other DNA
ataatcaaaaagttttcaca

SEQ ID NO: 17562 - DNA, 20 bp, synthetic construct
  source 1..20: mol_type = other DNA
ttcagagggtaaaattaagc

SEQ ID NO: 17563 - DNA, 20 bp, synthetic construct
  source 1..20: mol_type = other DNA
ataatcaaaaagttttcaca

SEQ ID NO: 17564 - DNA, 21 bp, synthetic construct
  source 1..21: mol_type = other DNA
cttcagagggtaaaattaagc

SEQ ID NO: 17565 - DNA, 21 bp, synthetic construct
  source 1..21: mol_type = other DNA
cttcagagggtaaaattaagc

SEQ ID NO: 17566 - DNA, 22 bp, synthetic construct
  source 1..22: mol_type = other DNA
gcataatcaaaaagttttcaca

SEQ ID NO: 17567 - DNA, 20 bp, synthetic construct
  source 1..20: mol_type = other DNA
ataatcaaaaagttttcaca

SEQ ID NO: 17568 - DNA, 20 bp, synthetic construct
  source 1..20: mol_type = other DNA
ataatcaaaaagttttcaca

SEQ ID NO: 17569 - DNA, 20 bp, synthetic construct
  source 1..20: mol_type = other DNA
ataatcaaaaagttttcaca

SEQ ID NO: 17570 - DNA, 21 bp, synthetic construct
  source 1..21: mol_type = other DNA
ccttcagagggtaaaattaag

SEQ ID NO: 17571 - DNA, 21 bp, synthetic construct
  source 1..21: mol_type = other DNA
ccttcagagggtaaaattaag

SEQ ID NO: 17572 - DNA, 21 bp, synthetic construct
  source 1..21: mol_type = other DNA
gcataatcaaaaagttttcac

SEQ ID NO: 17573 - DNA, 20 bp, synthetic construct
  source 1..20: mol_type = other DNA
cttcagagggtaaaattaag

SEQ ID NO: 17574 - DNA, 20 bp, synthetic construct
  source 1..20: mol_type = other DNA
cataatcaaaaagttttcac

SEQ ID NO: 17575 - DNA, 21 bp, synthetic construct
  source 1..21: mol_type = other DNA
gcataatcaaaaagttttcac

SEQ ID NO: 17576 - DNA, 21 bp, synthetic construct
  source 1..21: mol_type = other DNA
ccttcagagggtaaaattaag

SEQ ID NO: 17577 - DNA, 21 bp, synthetic construct
  source 1..21: mol_type = other DNA
gcataatcaaaaagttttcac

SEQ ID NO: 17578 - DNA, 21 bp, synthetic construct
  source 1..21: mol_type = other DNA
ccttcagagggtaaaattaag

SEQ ID NO: 17579 - DNA, 20 bp, synthetic construct
  source 1..20: mol_type = other DNA
cttcagagggtaaaattaag

SEQ ID NO: 17580 - DNA, 24 bp, synthetic construct
  source 1..24: mol_type = other DNA
atatgcataatcaaaaagttttca

SEQ ID NO: 17581 - DNA, 21 bp, synthetic construct
  source 1..21: mol_type = other DNA
tgcataatcaaaaagttttca

SEQ ID NO: 17582 - DNA, 21 bp, synthetic construct
  source 1..21: mol_type = other DNA
tgcataatcaaaaagttttca

SEQ ID NO: 17583 - DNA, 20 bp, synthetic construct
  source 1..20: mol_type = other DNA
ccttcagagggtaaaattaa

SEQ ID NO: 17584 - DNA, 20 bp, synthetic construct
  source 1..20: mol_type = other DNA
gcataatcaaaaagttttca

SEQ ID NO: 17585 - DNA, 24 bp, synthetic construct
  source 1..24: mol_type = other DNA
atatgcataatcaaaaagttttca

SEQ ID NO: 17586 - DNA, 20 bp, synthetic construct
  source 1..20: mol_type = other DNA
gcataatcaaaaagttttca

SEQ ID NO: 17587 - DNA, 20 bp, synthetic construct
  source 1..20: mol_type = other DNA
gccttcagagggtaaaatta

SEQ ID NO: 17588 - DNA, 20 bp, synthetic construct
  source 1..20: mol_type = other DNA
gccttcagagggtaaaatta

SEQ ID NO: 17589 - DNA, 20 bp, synthetic construct
  source 1..20: mol_type = other DNA
tgcataatcaaaaagttttc

SEQ ID NO: 17590 - DNA, 23 bp, synthetic construct
  source 1..23: mol_type = other DNA
ggagccttcagagggtaaaatta

SEQ ID NO: 17591 - DNA, 23 bp, synthetic construct
  source 1..23: mol_type = other DNA
ggagccttcagagggtaaaatta

SEQ ID NO: 17592 - DNA, 20 bp, synthetic construct
  source 1..20: mol_type = other DNA
gccttcagagggtaaaatta

SEQ ID NO: 17593 - DNA, 20 bp, synthetic construct
  source 1..20: mol_type = other DNA
gccttcagagggtaaaatta

SEQ ID NO: 17594 - DNA, 20 bp, synthetic construct
  source 1..20: mol_type = other DNA
gccttcagagggtaaaatta

SEQ ID NO: 17595 - DNA, 20 bp, synthetic construct
  source 1..20: mol_type = other DNA
gccttcagagggtaaaatta

SEQ ID NO: 17596 - DNA, 20 bp, synthetic construct
  source 1..20: mol_type = other DNA
agccttcagagggtaaaatt

SEQ ID NO: 17597 - DNA, 20 bp, synthetic construct
  source 1..20: mol_type = other DNA
agccttcagagggtaaaatt

SEQ ID NO: 17598 - DNA, 20 bp, synthetic construct
  source 1..20: mol_type = other DNA
atgcataatcaaaaagtttt

SEQ ID NO: 17599 - DNA, 20 bp, synthetic construct
  source 1..20: mol_type = other DNA
agccttcagagggtaaaatt

SEQ ID NO: 17600 - DNA, 20 bp, synthetic construct
  source 1..20: mol_type = other DNA
agccttcagagggtaaaatt

SEQ ID NO: 17601 - DNA, 20 bp, synthetic construct
  source 1..20: mol_type = other DNA
agccttcagagggtaaaatt

SEQ ID NO: 17602 - DNA, 20 bp, synthetic construct
  source 1..20: mol_type = other DNA
atgcataatcaaaaagtttt

SEQ ID NO: 17603 - DNA, 21 bp, synthetic construct
  source 1..21: mol_type = other DNA
ggagccttcagagggtaaaat

SEQ ID NO: 17604 - DNA, 20 bp, synthetic construct
  source 1..20: mol_type = other DNA
gagccttcagagggtaaaat

SEQ ID NO: 17605 - DNA, 20 bp, synthetic construct
  source 1..20: mol_type = other DNA
tatgcataatcaaaaagttt

SEQ ID NO: 17606 - DNA, 23 bp, synthetic construct
  source 1..23: mol_type = other DNA
ctggagccttcagagggtaaaat

SEQ ID NO: 17607 - DNA, 21 bp, synthetic construct
  source 1..21: mol_type = other DNA
ggagccttcagagggtaaaat

SEQ ID NO: 17608 - DNA, 20 bp, synthetic construct
  source 1..20: mol_type = other DNA
gagccttcagagggtaaaat

SEQ ID NO: 17609 - DNA, 21 bp, synthetic construct
  source 1..21: mol_type = other DNA
tggagccttcagagggtaaaa

SEQ ID NO: 17610 - DNA, 20 bp, synthetic construct
  source 1..20: mol_type = other DNA
ggagccttcagagggtaaaa

SEQ ID NO: 17611 - DNA, 20 bp, synthetic construct
  source 1..20: mol_type = other DNA
atatgcataatcaaaaagtt

SEQ ID NO: 17612 - DNA, 23 bp, synthetic construct
  source 1..23: mol_type = other DNA
ttcatatgcataatcaaaaagtt

SEQ ID NO: 17613 - DNA, 23 bp, synthetic construct
  source 1..23: mol_type = other DNA
ttcatatgcataatcaaaaagtt

SEQ ID NO: 17614 - DNA, 21 bp, synthetic construct
  source 1..21: mol_type = other DNA
tggagccttcagagggtaaaa

SEQ ID NO: 17615 - DNA, 21 bp, synthetic construct
  source 1..21: mol_type = other DNA
tggagccttcagagggtaaaa

SEQ ID NO: 17616 - DNA, 23 bp, synthetic construct
  source 1..23: mol_type = other DNA
actggagccttcagagggtaaaa

SEQ ID NO: 17617 - DNA, 21 bp, synthetic construct
  source 1..21: mol_type = other DNA
ctggagccttcagagggtaaa

SEQ ID NO: 17618 - DNA, 20 bp, synthetic construct
  source 1..20: mol_type = other DNA
tggagccttcagagggtaaa

SEQ ID NO: 17619 - DNA, 20 bp, synthetic construct
  source 1..20: mol_type = other DNA
catatgcataatcaaaaagt

SEQ ID NO: 17620 - DNA, 20 bp, synthetic construct
  source 1..20: mol_type = other DNA
ctggagccttcagagggtaa

SEQ ID NO: 17621 - DNA, 20 bp, synthetic construct
  source 1..20: mol_type = other DNA
tcatatgcataatcaaaaag

SEQ ID NO: 17622 - DNA, 23 bp, synthetic construct
  source 1..23: mol_type = other DNA
ggttcatatgcataatcaaaaag

SEQ ID NO: 17623 - DNA, 20 bp, synthetic construct
  source 1..20: mol_type = other DNA
ctggagccttcagagggtaa

SEQ ID NO: 17624 - DNA, 20 bp, synthetic construct
  source 1..20: mol_type = other DNA
actggagccttcagagggta

SEQ ID NO: 17625 - DNA, 20 bp, synthetic construct
  source 1..20: mol_type = other DNA
ttcatatgcataatcaaaaa

SEQ ID NO: 17626 - DNA, 21 bp, synthetic construct
  source 1..21: mol_type = other DNA
aactggagccttcagagggta

SEQ ID NO: 17627 - DNA, 20 bp, synthetic construct
  source 1..20: mol_type = other DNA
actggagccttcagagggta

SEQ ID NO: 17628 - DNA, 20 bp, synthetic construct
  source 1..20: mol_type = other DNA
gttcatatgcataatcaaaa

SEQ ID NO: 17629 - DNA, 20 bp, synthetic construct
  source 1..20: mol_type = other DNA
aactggagccttcagagggt

SEQ ID NO: 17630 - DNA, 20 bp, synthetic construct
  source 1..20: mol_type = other DNA
gttcatatgcataatcaaaa

SEQ ID NO: 17631 - DNA, 21 bp, synthetic construct
  source 1..21: mol_type = other DNA
gaactggagccttcagagggt

SEQ ID NO: 17632 - DNA, 21 bp, synthetic construct
  source 1..21: mol_type = other DNA
gaactggagccttcagagggt

SEQ ID NO: 17633 - DNA, 21 bp, synthetic construct
  source 1..21: mol_type = other DNA
gaactggagccttcagagggt

SEQ ID NO: 17634 - DNA, 20 bp, synthetic construct
  source 1..20: mol_type = other DNA
aactggagccttcagagggt

SEQ ID NO: 17635 - DNA, 20 bp, synthetic construct
  source 1..20: mol_type = other DNA
gttcatatgcataatcaaaa

SEQ ID NO: 17636 - DNA, 20 bp, synthetic construct
  source 1..20: mol_type = other DNA
gttcatatgcataatcaaaa

SEQ ID NO: 17637 - DNA, 20 bp, synthetic construct
  source 1..20: mol_type = other DNA
gttcatatgcataatcaaaa

SEQ ID NO: 17638 - DNA, 20 bp, synthetic construct
  source 1..20: mol_type = other DNA
gttcatatgcataatcaaaa

SEQ ID NO: 17639 - DNA, 24 bp, synthetic construct
  source 1..24: mol_type = other DNA
gggagaactggagccttcagaggg

SEQ ID NO: 17640 - DNA, 21 bp, synthetic construct
  source 1..21: mol_type = other DNA
agaactggagccttcagaggg

SEQ ID NO: 17641 - DNA, 21 bp, synthetic construct
  source 1..21: mol_type = other DNA
agaactggagccttcagaggg

SEQ ID NO: 17642 - DNA, 20 bp, synthetic construct
  source 1..20: mol_type = other DNA
ggttcatatgcataatcaaa

SEQ ID NO: 17643 - DNA, 20 bp, synthetic construct
  source 1..20: mol_type = other DNA
gaactggagccttcagaggg

SEQ ID NO: 17644 - DNA, 20 bp, synthetic construct
  source 1..20: mol_type = other DNA
ggttcatatgcataatcaaa

SEQ ID NO: 17645 - DNA, 21 bp, synthetic construct
  source 1..21: mol_type = other DNA
agaactggagccttcagaggg

SEQ ID NO: 17646 - DNA, 21 bp, synthetic construct
  source 1..21: mol_type = other DNA
agaactggagccttcagaggg

SEQ ID NO: 17647 - DNA, 22 bp, synthetic construct
  source 1..22: mol_type = other DNA
gagaactggagccttcagaggg

SEQ ID NO: 17648 - DNA, 22 bp, synthetic construct
  source 1..22: mol_type = other DNA
agggttcatatgcataatcaaa

SEQ ID NO: 17649 - DNA, 21 bp, synthetic construct
  source 1..21: mol_type = other DNA
agaactggagccttcagaggg

SEQ ID NO: 17650 - DNA, 20 bp, synthetic construct
  source 1..20: mol_type = other DNA
ggttcatatgcataatcaaa

SEQ ID NO: 17651 - DNA, 20 bp, synthetic construct
  source 1..20: mol_type = other DNA
ggttcatatgcataatcaaa

SEQ ID NO: 17652 - DNA, 20 bp, synthetic construct
  source 1..20: mol_type = other DNA
gaactggagccttcagaggg

SEQ ID NO: 17653 - DNA, 20 bp, synthetic construct
  source 1..20: mol_type = other DNA
ggttcatatgcataatcaaa

SEQ ID NO: 17654 - DNA, 21 bp, synthetic construct
  source 1..21: mol_type = other DNA
gagaactggagccttcagagg

SEQ ID NO: 17655 - DNA, 21 bp, synthetic construct
  source 1..21: mol_type = other DNA
agggttcatatgcataatcaa

SEQ ID NO: 17656 - DNA, 20 bp, synthetic construct
  source 1..20: mol_type = other DNA
agaactggagccttcagagg

SEQ ID NO: 17657 - DNA, 20 bp, synthetic construct
  source 1..20: mol_type = other DNA
gggttcatatgcataatcaa

SEQ ID NO: 17658 - DNA, 21 bp, synthetic construct
  source 1..21: mol_type = other DNA
agggttcatatgcataatcaa

SEQ ID NO: 17659 - DNA, 21 bp, synthetic construct
  source 1..21: mol_type = other DNA
gagaactggagccttcagagg

SEQ ID NO: 17660 - DNA, 21 bp, synthetic construct
  source 1..21: mol_type = other DNA
agggttcatatgcataatcaa

SEQ ID NO: 17661 - DNA, 21 bp, synthetic construct
  source 1..21: mol_type = other DNA
gagaactggagccttcagagg

SEQ ID NO: 17662 - DNA, 22 bp, synthetic construct
  source 1..22: mol_type = other DNA
ggagaactggagccttcagagg

SEQ ID NO: 17663 - DNA, 22 bp, synthetic construct
  source 1..22: mol_type = other DNA
ggagaactggagccttcagagg

SEQ ID NO: 17664 - DNA, 21 bp, synthetic construct
  source 1..21: mol_type = other DNA
agggttcatatgcataatcaa

SEQ ID NO: 17665 - DNA, 20 bp, synthetic construct
  source 1..20: mol_type = other DNA
gggttcatatgcataatcaa

SEQ ID NO: 17666 - DNA, 20 bp, synthetic construct
  source 1..20: mol_type = other DNA
agaactggagccttcagagg

SEQ ID NO: 17667 - DNA, 24 bp, synthetic construct
  source 1..24: mol_type = other DNA
gtgaagggttcatatgcataatca

SEQ ID NO: 17668 - DNA, 21 bp, synthetic construct
  source 1..21: mol_type = other DNA
ggagaactggagccttcagag

SEQ ID NO: 17669 - DNA, 21 bp, synthetic construct
  source 1..21: mol_type = other DNA
aagggttcatatgcataatca

SEQ ID NO: 17670 - DNA, 21 bp, synthetic construct
  source 1..21: mol_type = other DNA
aagggttcatatgcataatca

SEQ ID NO: 17671 - DNA, 20 bp, synthetic construct
  source 1..20: mol_type = other DNA
gagaactggagccttcagag

SEQ ID NO: 17672 - DNA, 20 bp, synthetic construct
  source 1..20: mol_type = other DNA
gagaactggagccttcagag

SEQ ID NO: 17673 - DNA, 20 bp, synthetic construct
  source 1..20: mol_type = other DNA
agggttcatatgcataatca

SEQ ID NO: 17674 - DNA, 21 bp, synthetic construct
  source 1..21: mol_type = other DNA
aagggttcatatgcataatca

SEQ ID NO: 17675 - DNA, 21 bp, synthetic construct
  source 1..21: mol_type = other DNA
aagggttcatatgcataatca

SEQ ID NO: 17676 - DNA, 21 bp, synthetic construct
  source 1..21: mol_type = other DNA
aagggttcatatgcataatca

SEQ ID NO: 17677 - DNA, 24 bp, synthetic construct
  source 1..24: mol_type = other DNA
gtgaagggttcatatgcataatca

SEQ ID NO: 17678 - DNA, 20 bp, synthetic construct
  source 1..20: mol_type = other DNA
agggttcatatgcataatca

SEQ ID NO: 17679 - DNA, 20 bp, synthetic construct
  source 1..20: mol_type = other DNA
gagaactggagccttcagag

SEQ ID NO: 17680 - DNA, 20 bp, synthetic construct
  source 1..20: mol_type = other DNA
gagaactggagccttcagag

SEQ ID NO: 17681 - DNA, 20 bp, synthetic construct
  source 1..20: mol_type = other DNA
gagaactggagccttcagag

SEQ ID NO: 17682 - DNA, 20 bp, synthetic construct
  source 1..20: mol_type = other DNA
gagaactggagccttcagag

SEQ ID NO: 17683 - DNA, 21 bp, synthetic construct
  source 1..21: mol_type = other DNA
gaagggttcatatgcataatc

SEQ ID NO: 17684 - DNA, 20 bp, synthetic construct
  source 1..20: mol_type = other DNA
ggagaactggagccttcaga

SEQ ID NO: 17685 - DNA, 20 bp, synthetic construct
  source 1..20: mol_type = other DNA
ggagaactggagccttcaga

SEQ ID NO: 17686 - DNA, 20 bp, synthetic construct
  source 1..20: mol_type = other DNA
ggagaactggagccttcaga

SEQ ID NO: 17687 - DNA, 20 bp, synthetic construct
  source 1..20: mol_type = other DNA
ggagaactggagccttcaga

SEQ ID NO: 17688 - DNA, 20 bp, synthetic construct
  source 1..20: mol_type = other DNA
aagggttcatatgcataatc

SEQ ID NO: 17689 - DNA, 21 bp, synthetic construct
  source 1..21: mol_type = other DNA
gaagggttcatatgcataatc

SEQ ID NO: 17690 - DNA, 21 bp, synthetic construct
  source 1..21: mol_type = other DNA
gaagggttcatatgcataatc

SEQ ID NO: 17691 - DNA, 21 bp, synthetic construct
  source 1..21: mol_type = other DNA
gaagggttcatatgcataatc

SEQ ID NO: 17692 - DNA, 20 bp, synthetic construct
  source 1..20: mol_type = other DNA
ggagaactggagccttcaga

SEQ ID NO: 17693 - DNA, 20 bp, synthetic construct
  source 1..20: mol_type = other DNA
ggagaactggagccttcaga

SEQ ID NO: 17694 - DNA, 20 bp, synthetic construct
  source 1..20: mol_type = other DNA
ggagaactggagccttcaga

SEQ ID NO: 17695 - DNA, 20 bp, synthetic construct
  source 1..20: mol_type = other DNA
aagggttcatatgcataatc

SEQ ID NO: 17696 - DNA, 20 bp, synthetic construct
  source 1..20: mol_type = other DNA
ggagaactggagccttcaga

SEQ ID NO: 17697 - DNA, 20 bp, synthetic construct
  source 1..20: mol_type = other DNA
ggagaactggagccttcaga

SEQ ID NO: 17698 - DNA, 20 bp, synthetic construct
  source 1..20: mol_type = other DNA
ggagaactggagccttcaga

SEQ ID NO: 17699 - DNA, 20 bp, synthetic construct
  source 1..20: mol_type = other DNA
ggagaactggagccttcaga

SEQ ID NO: 17700 - DNA, 21 bp, synthetic construct
  source 1..21: mol_type = other DNA
tgaagggttcatatgcataat

SEQ ID NO: 17701 - DNA, 21 bp, synthetic construct
  source 1..21: mol_type = other DNA
tgggagaactggagccttcag

SEQ ID NO: 17702 - DNA, 21 bp, synthetic construct
  source 1..21: mol_type = other DNA
tgggagaactggagccttcag

SEQ ID NO: 17703 - DNA, 20 bp, synthetic construct
  source 1..20: mol_type = other DNA
gggagaactggagccttcag

SEQ ID NO: 17704 - DNA, 20 bp, synthetic construct
  source 1..20: mol_type = other DNA
gggagaactggagccttcag

SEQ ID NO: 17705 - DNA, 20 bp, synthetic construct
  source 1..20: mol_type = other DNA
gggagaactggagccttcag

SEQ ID NO: 17706 - DNA, 20 bp, synthetic construct
  source 1..20: mol_type = other DNA
gggagaactggagccttcag

SEQ ID NO: 17707 - DNA, 20 bp, synthetic construct
  source 1..20: mol_type = other DNA
gaagggttcatatgcataat

SEQ ID NO: 17708 - DNA, 21 bp, synthetic construct
  source 1..21: mol_type = other DNA
tgaagggttcatatgcataat

SEQ ID NO: 17709 - DNA, 21 bp, synthetic construct
  source 1..21: mol_type = other DNA
tgaagggttcatatgcataat

SEQ ID NO: 17710 - DNA, 21 bp, synthetic construct
  source 1..21: mol_type = other DNA
tgaagggttcatatgcataat

SEQ ID NO: 17711 - DNA, 20 bp, synthetic construct
  source 1..20: mol_type = other DNA
gggagaactggagccttcag

SEQ ID NO: 17712 - DNA, 20 bp, synthetic construct
  source 1..20: mol_type = other DNA
gggagaactggagccttcag

SEQ ID NO: 17713 - DNA, 20 bp, synthetic construct
  source 1..20: mol_type = other DNA
gaagggttcatatgcataat

SEQ ID NO: 17714 - DNA, 20 bp, synthetic construct
  source 1..20: mol_type = other DNA
gggagaactggagccttcag

SEQ ID NO: 17715 - DNA, 20 bp, synthetic construct
  source 1..20: mol_type = other DNA
gggagaactggagccttcag

SEQ ID NO: 17716 - DNA, 20 bp, synthetic construct
  source 1..20: mol_type = other DNA
gggagaactggagccttcag

SEQ ID NO: 17717 - DNA, 20 bp, synthetic construct
  source 1..20: mol_type = other DNA
gggagaactggagccttcag

SEQ ID NO: 17718 - DNA, 20 bp, synthetic construct
  source 1..20: mol_type = other DNA
gaagggttcatatgcataat

SEQ ID NO: 17719 - DNA, 23 bp, synthetic construct
  source 1..23: mol_type = other DNA
ttatgggagaactggagccttca

SEQ ID NO: 17720 - DNA, 23 bp, synthetic construct
  source 1..23: mol_type = other DNA
ttatgggagaactggagccttca

SEQ ID NO: 17721 - DNA, 21 bp, synthetic construct
  source 1..21: mol_type = other DNA
atgggagaactggagccttca

SEQ ID NO: 17722 - DNA, 21 bp, synthetic construct
  source 1..21: mol_type = other DNA
atgggagaactggagccttca

SEQ ID NO: 17723 - DNA, 21 bp, synthetic construct
  source 1..21: mol_type = other DNA
gtgaagggttcatatgcataa

SEQ ID NO: 17724 - DNA, 21 bp, synthetic construct
  source 1..21: mol_type = other DNA
atgggagaactggagccttca

SEQ ID NO: 17725 - DNA, 21 bp, synthetic construct
  source 1..21: mol_type = other DNA
atgggagaactggagccttca

SEQ ID NO: 17726 - DNA, 20 bp, synthetic construct
  source 1..20: mol_type = other DNA
tgggagaactggagccttca

SEQ ID NO: 17727 - DNA, 20 bp, synthetic construct
  source 1..20: mol_type = other DNA
tgggagaactggagccttca

SEQ ID NO: 17728 - DNA, 20 bp, synthetic construct
  source 1..20: mol_type = other DNA
tgaagggttcatatgcataa

SEQ ID NO: 17729 - DNA, 21 bp, synthetic construct
  source 1..21: mol_type = other DNA
atgggagaactggagccttca

SEQ ID NO: 17730 - DNA, 21 bp, synthetic construct
  source 1..21: mol_type = other DNA
gtgaagggttcatatgcataa

SEQ ID NO: 17731 - DNA, 21 bp, synthetic construct
  source 1..21: mol_type = other DNA
atgggagaactggagccttca

SEQ ID NO: 17732 - DNA, 21 bp, synthetic construct
  source 1..21: mol_type = other DNA
gtgaagggttcatatgcataa

SEQ ID NO: 17733 - DNA, 20 bp, synthetic construct
  source 1..20: mol_type = other DNA
tgggagaactggagccttca

SEQ ID NO: 17734 - DNA, 20 bp, synthetic construct
  source 1..20: mol_type = other DNA
tgggagaactggagccttca

SEQ ID NO: 17735 - DNA, 20 bp, synthetic construct
  source 1..20: mol_type = other DNA
tgaagggttcatatgcataa

SEQ ID NO: 17736 - DNA, 21 bp, synthetic construct
  source 1..21: mol_type = other DNA
tatgggagaactggagccttc

SEQ ID NO: 17737 - DNA, 21 bp, synthetic construct
  source 1..21: mol_type = other DNA
tgtgaagggttcatatgcata

SEQ ID NO: 17738 - DNA, 21 bp, synthetic construct
  source 1..21: mol_type = other DNA
tatgggagaactggagccttc

SEQ ID NO: 17739 - DNA, 20 bp, synthetic construct
  source 1..20: mol_type = other DNA
atgggagaactggagccttc

SEQ ID NO: 17740 - DNA, 20 bp, synthetic construct
  source 1..20: mol_type = other DNA
atgggagaactggagccttc

SEQ ID NO: 17741 - DNA, 20 bp, synthetic construct
  source 1..20: mol_type = other DNA
gtgaagggttcatatgcata

SEQ ID NO: 17742 - DNA, 21 bp, synthetic construct
  source 1..21: mol_type = other DNA
tatgggagaactggagccttc

SEQ ID NO: 17743 - DNA, 21 bp, synthetic construct
  source 1..21: mol_type = other DNA
tgtgaagggttcatatgcata

SEQ ID NO: 17744 - DNA, 21 bp, synthetic construct
  source 1..21: mol_type = other DNA
tatgggagaactggagccttc

SEQ ID NO: 17745 - DNA, 21 bp, synthetic construct
  source 1..21: mol_type = other DNA
tgtgaagggttcatatgcata

SEQ ID NO: 17746 - DNA, 20 bp, synthetic construct
  source 1..20: mol_type = other DNA
atgggagaactggagccttc

SEQ ID NO: 17747 - DNA, 20 bp, synthetic construct
  source 1..20: mol_type = other DNA
atgggagaactggagccttc

SEQ ID NO: 17748 - DNA, 20 bp, synthetic construct
  source 1..20: mol_type = other DNA
atgggagaactggagccttc

SEQ ID NO: 17749 - DNA, 20 bp, synthetic construct
  source 1..20: mol_type = other DNA
atgggagaactggagccttc

SEQ ID NO: 17750 - DNA, 23 bp, synthetic construct
  source 1..23: mol_type = other DNA
gattatgggagaactggagcctt

SEQ ID NO: 17751 - DNA, 21 bp, synthetic construct
  source 1..21: mol_type = other DNA
ttatgggagaactggagcctt

SEQ ID NO: 17752 - DNA, 20 bp, synthetic construct
  source 1..20: mol_type = other DNA
tatgggagaactggagcctt

SEQ ID NO: 17753 - DNA, 20 bp, synthetic construct
  source 1..20: mol_type = other DNA
tatgggagaactggagcctt

SEQ ID NO: 17754 - DNA, 20 bp, synthetic construct
  source 1..20: mol_type = other DNA
tgtgaagggttcatatgcat

SEQ ID NO: 17755 - DNA, 21 bp, synthetic construct
  source 1..21: mol_type = other DNA
ttatgggagaactggagcctt

SEQ ID NO: 17756 - DNA, 21 bp, synthetic construct
  source 1..21: mol_type = other DNA
ttatgggagaactggagcctt

SEQ ID NO: 17757 - DNA, 20 bp, synthetic construct
  source 1..20: mol_type = other DNA
tatgggagaactggagcctt

SEQ ID NO: 17758 - DNA, 20 bp, synthetic construct
  source 1..20: mol_type = other DNA
tatgggagaactggagcctt

SEQ ID NO: 17759 - DNA, 20 bp, synthetic construct
  source 1..20: mol_type = other DNA
tatgggagaactggagcctt

SEQ ID NO: 17760 - DNA, 20 bp, synthetic construct
  source 1..20: mol_type = other DNA
tgtgaagggttcatatgcat

SEQ ID NO: 17761 - DNA, 21 bp, synthetic construct
  source 1..21: mol_type = other DNA
attatgggagaactggagcct

SEQ ID NO: 17762 - DNA, 21 bp, synthetic construct
  source 1..21: mol_type = other DNA
attatgggagaactggagcct

SEQ ID NO: 17763 - DNA, 20 bp, synthetic construct
  source 1..20: mol_type = other DNA
ttatgggagaactggagcct

SEQ ID NO: 17764 - DNA, 20 bp, synthetic construct
  source 1..20: mol_type = other DNA
gtgtgaagggttcatatgca

SEQ ID NO: 17765 - DNA, 23 bp, synthetic construct
  source 1..23: mol_type = other DNA
gtagtgtgaagggttcatatgca

SEQ ID NO: 17766 - DNA, 23 bp, synthetic construct
  source 1..23: mol_type = other DNA
gtagtgtgaagggttcatatgca

SEQ ID NO: 17767 - DNA, 23 bp, synthetic construct
  source 1..23: mol_type = other DNA
gtagtgtgaagggttcatatgca

SEQ ID NO: 17768 - DNA, 21 bp, synthetic construct
  source 1..21: mol_type = other DNA
attatgggagaactggagcct

SEQ ID NO: 17769 - DNA, 21 bp, synthetic construct
  source 1..21: mol_type = other DNA
attatgggagaactggagcct

SEQ ID NO: 17770 - DNA, 23 bp, synthetic construct
  source 1..23: mol_type = other DNA
gtagtgtgaagggttcatatgca

SEQ ID NO: 17771 - DNA, 21 bp, synthetic construct
  source 1..21: mol_type = other DNA
agtgtgaagggttcatatgca

SEQ ID NO: 17772 - DNA, 20 bp, synthetic construct
  source 1..20: mol_type = other DNA
gtgtgaagggttcatatgca

SEQ ID NO: 17773 - DNA, 21 bp, synthetic construct
  source 1..21: mol_type = other DNA
gattatgggagaactggagcc

SEQ ID NO: 17774 - DNA, 20 bp, synthetic construct
  source 1..20: mol_type = other DNA
attatgggagaactggagcc

SEQ ID NO: 17775 - DNA, 20 bp, synthetic construct
  source 1..20: mol_type = other DNA
agtgtgaagggttcatatgc

SEQ ID NO: 17776 - DNA, 21 bp, synthetic construct
  source 1..21: mol_type = other DNA
gattatgggagaactggagcc

SEQ ID NO: 17777 - DNA, 21 bp, synthetic construct
  source 1..21: mol_type = other DNA
gattatgggagaactggagcc

SEQ ID NO: 17778 - DNA, 21 bp, synthetic construct
  source 1..21: mol_type = other DNA
gtagtgtgaagggttcatatg

SEQ ID NO: 17779 - DNA, 21 bp, synthetic construct
  source 1..21: mol_type = other DNA
gtagtgtgaagggttcatatg

SEQ ID NO: 17780 - DNA, 20 bp, synthetic construct
  source 1..20: mol_type = other DNA
gattatgggagaactggagc

SEQ ID NO: 17781 - DNA, 20 bp, synthetic construct
  source 1..20: mol_type = other DNA
tagtgtgaagggttcatatg

SEQ ID NO: 17782 - DNA, 20 bp, synthetic construct
  source 1..20: mol_type = other DNA
tagtgtgaagggttcatatg

SEQ ID NO: 17783 - DNA, 20 bp, synthetic construct
  source 1..20: mol_type = other DNA
tgattatgggagaactggag

SEQ ID NO: 17784 - DNA, 20 bp, synthetic construct
  source 1..20: mol_type = other DNA
gtagtgtgaagggttcatat

SEQ ID NO: 17785 - DNA, 23 bp, synthetic construct
  source 1..23: mol_type = other DNA
tggtgattatgggagaactggag

SEQ ID NO: 17786 - DNA, 23 bp, synthetic construct
  source 1..23: mol_type = other DNA
tggtgattatgggagaactggag

SEQ ID NO: 17787 - DNA, 22 bp, synthetic construct
  source 1..22: mol_type = other DNA
gggtagtgtgaagggttcatat

SEQ ID NO: 17788 - DNA, 20 bp, synthetic construct
  source 1..20: mol_type = other DNA
ggtagtgtgaagggttcata

SEQ ID NO: 17789 - DNA, 20 bp, synthetic construct
  source 1..20: mol_type = other DNA
gtgattatgggagaactgga

SEQ ID NO: 17790 - DNA, 20 bp, synthetic construct
  source 1..20: mol_type = other DNA
ggtagtgtgaagggttcata

SEQ ID NO: 17791 - DNA, 20 bp, synthetic construct
  source 1..20: mol_type = other DNA
ggtagtgtgaagggttcata

SEQ ID NO: 17792 - DNA, 20 bp, synthetic construct
  source 1..20: mol_type = other DNA
ggtagtgtgaagggttcata

SEQ ID NO: 17793 - DNA, 20 bp, synthetic construct
  source 1..20: mol_type = other DNA
ggtagtgtgaagggttcata

SEQ ID NO: 17794 - DNA, 20 bp, synthetic construct
  source 1..20: mol_type = other DNA
ggtagtgtgaagggttcata

SEQ ID NO: 17795 - DNA, 20 bp, synthetic construct
  source 1..20: mol_type = other DNA
gggtagtgtgaagggttcat

SEQ ID NO: 17796 - DNA, 20 bp, synthetic construct
  source 1..20: mol_type = other DNA
ggtgattatgggagaactgg

SEQ ID NO: 17797 - DNA, 20 bp, synthetic construct
  source 1..20: mol_type = other DNA
ggtgattatgggagaactgg

SEQ ID NO: 17798 - DNA, 20 bp, synthetic construct
  source 1..20: mol_type = other DNA
gggtagtgtgaagggttcat

SEQ ID NO: 17799 - DNA, 20 bp, synthetic construct
  source 1..20: mol_type = other DNA
gggtagtgtgaagggttcat

SEQ ID NO: 17800 - DNA, 20 bp, synthetic construct
  source 1..20: mol_type = other DNA
gggtagtgtgaagggttcat

SEQ ID NO: 17801 - DNA, 20 bp, synthetic construct
  source 1..20: mol_type = other DNA
ggtgattatgggagaactgg

SEQ ID NO: 17802 - DNA, 20 bp, synthetic construct
  source 1..20: mol_type = other DNA
ggtgattatgggagaactgg

SEQ ID NO: 17803 - DNA, 20 bp, synthetic construct
  source 1..20: mol_type = other DNA
ggtgattatgggagaactgg

SEQ ID NO: 17804 - DNA, 20 bp, synthetic construct
  source 1..20: mol_type = other DNA
ggtgattatgggagaactgg

SEQ ID NO: 17805 - DNA, 20 bp, synthetic construct
  source 1..20: mol_type = other DNA
tggtgattatgggagaactg

SEQ ID NO: 17806 - DNA, 20 bp, synthetic construct
  source 1..20: mol_type = other DNA
tggtgattatgggagaactg

SEQ ID NO: 17807 - DNA, 20 bp, synthetic construct
  source 1..20: mol_type = other DNA
tgggtagtgtgaagggttca

SEQ ID NO: 17808 - DNA, 23 bp, synthetic construct
  source 1..23: mol_type = other DNA
taatggtgattatgggagaactg

SEQ ID NO: 17809 - DNA, 23 bp, synthetic construct
  source 1..23: mol_type = other DNA
atttgggtagtgtgaagggttca

SEQ ID NO: 17810 - DNA, 23 bp, synthetic construct
  source 1..23: mol_type = other DNA
atttgggtagtgtgaagggttca

SEQ ID NO: 17811 - DNA, 22 bp, synthetic construct
  source 1..22: mol_type = other DNA
aatggtgattatgggagaactg

SEQ ID NO: 17812 - DNA, 20 bp, synthetic construct
  source 1..20: mol_type = other DNA
tggtgattatgggagaactg

SEQ ID NO: 17813 - DNA, 20 bp, synthetic construct
  source 1..20: mol_type = other DNA
tggtgattatgggagaactg

SEQ ID NO: 17814 - DNA, 20 bp, synthetic construct
  source 1..20: mol_type = other DNA
tggtgattatgggagaactg

SEQ ID NO: 17815 - DNA, 24 bp, synthetic construct
  source 1..24: mol_type = other DNA
tctaatggtgattatgggagaact

SEQ ID NO: 17816 - DNA, 21 bp, synthetic construct
  source 1..21: mol_type = other DNA
aatggtgattatgggagaact

SEQ ID NO: 17817 - DNA, 20 bp, synthetic construct
  source 1..20: mol_type = other DNA
atggtgattatgggagaact

SEQ ID NO: 17818 - DNA, 20 bp, synthetic construct
  source 1..20: mol_type = other DNA
atggtgattatgggagaact

SEQ ID NO: 17819 - DNA, 20 bp, synthetic construct
  source 1..20: mol_type = other DNA
ttgggtagtgtgaagggttc

SEQ ID NO: 17820 - DNA, 23 bp, synthetic construct
  source 1..23: mol_type = other DNA
ctaatggtgattatgggagaact

SEQ ID NO: 17821 - DNA, 23 bp, synthetic construct
  source 1..23: mol_type = other DNA
ctaatggtgattatgggagaact

SEQ ID NO: 17822 - DNA, 20 bp, synthetic construct
  source 1..20: mol_type = other DNA
atggtgattatgggagaact

SEQ ID NO: 17823 - DNA, 20 bp, synthetic construct
  source 1..20: mol_type = other DNA
atggtgattatgggagaact

SEQ ID NO: 17824 - DNA, 20 bp, synthetic construct
  source 1..20: mol_type = other DNA
atggtgattatgggagaact

SEQ ID NO: 17825 - DNA, 20 bp, synthetic construct
  source 1..20: mol_type = other DNA
atggtgattatgggagaact

SEQ ID NO: 17826 - DNA, 23 bp, synthetic construct
  source 1..23: mol_type = other DNA
tctaatggtgattatgggagaac

SEQ ID NO: 17827 - DNA, 21 bp, synthetic construct
  source 1..21: mol_type = other DNA
taatggtgattatgggagaac

SEQ ID NO: 17828 - DNA, 20 bp, synthetic construct
  source 1..20: mol_type = other DNA
aatggtgattatgggagaac

SEQ ID NO: 17829 - DNA, 20 bp, synthetic construct
  source 1..20: mol_type = other DNA
aatggtgattatgggagaac

SEQ ID NO: 17830 - DNA, 20 bp, synthetic construct
  source 1..20: mol_type = other DNA
aatggtgattatgggagaac

SEQ ID NO: 17831 - DNA, 20 bp, synthetic construct
  source 1..20: mol_type = other DNA
aatggtgattatgggagaac

SEQ ID NO: 17832 - DNA, 21 bp, synthetic construct
  source 1..21: mol_type = other DNA
taatggtgattatgggagaac

SEQ ID NO: 17833 - DNA, 21 bp, synthetic construct
  source 1..21: mol_type = other DNA
taatggtgattatgggagaac

SEQ ID NO: 17834 - DNA, 20 bp, synthetic construct
  source 1..20: mol_type = other DNA
aatggtgattatgggagaac

SEQ ID NO: 17835 - DNA, 20 bp, synthetic construct
  source 1..20: mol_type = other DNA
aatggtgattatgggagaac

SEQ ID NO: 17836 - DNA, 20 bp, synthetic construct
  source 1..20: mol_type = other DNA
aatggtgattatgggagaac

SEQ ID NO: 17837 - DNA, 20 bp, synthetic construct
  source 1..20: mol_type = other DNA
aatggtgattatgggagaac

SEQ ID NO: 17838 - DNA, 20 bp, synthetic construct
  source 1..20: mol_type = other DNA
aatggtgattatgggagaac

SEQ ID NO: 17839 - DNA, 20 bp, synthetic construct
  source 1..20: mol_type = other DNA
aatggtgattatgggagaac

SEQ ID NO: 17840 - DNA, 20 bp, synthetic construct
  source 1..20: mol_type = other DNA
aatggtgattatgggagaac

SEQ ID NO: 17841 - DNA, 53 bp, synthetic construct
  source 1..53: mol_type = other DNA
gcatgctttgatgacgcttctgtatctatattcatcataggaaacaccaaaga

SEQ ID NO: 17842 - DNA, 56 bp, synthetic construct
  source 1..56: mol_type = other DNA
tgttctcagttttcctggattatgcctggcaccattaaagaaaatatcatctttgg

SEQ ID NO: 17843 - DNA, 53 bp, synthetic construct; identical to SEQ ID NO: 17841
  source 1..53: mol_type = other DNA

SEQ ID NO: 17844 - DNA, 56 bp, synthetic construct; identical to SEQ ID NO: 17842
  source 1..56: mol_type = other DNA

SEQ ID NO: 17845 - DNA, 57 bp, synthetic construct
  source 1..57: mol_type = other DNA
tgttctcagttttcctggattatgcctggcaccattaaagaaaatatcatctttggt

SEQ ID NO: 17846 - DNA, 57 bp, synthetic construct; identical to SEQ ID NO: 17845
  source 1..57: mol_type = other DNA

SEQ ID NO: 17847 - DNA, 54 bp, synthetic construct
  source 1..54: mol_type = other DNA
gcatgctttgatgacgcttctgtatctatattcatcataggaaacaccaaagat

SEQ ID NO: 17848 - DNA, 54 bp, synthetic construct; identical to SEQ ID NO: 17847
  source 1..54: mol_type = other DNA

SEQ ID NO: 17849 - DNA, 57 bp, synthetic construct; identical to SEQ ID NO: 17845
  source 1..57: mol_type = other DNA

SEQ ID NO: 17850 - DNA, 55 bp, synthetic construct
  source 1..55: mol_type = other DNA
gcatgctttgatgacgcttctgtatctatattcatcataggaaacaccaaagatg

SEQ ID NO: 17851 - DNA, 55 bp, synthetic construct; identical to SEQ ID NO: 17850
  source 1..55: mol_type = other DNA

SEQ ID NO: 17852 - DNA, 55 bp, synthetic construct; identical to SEQ ID NO: 17850
  source 1..55: mol_type = other DNA

SEQ ID NO: 17853 - DNA, 55 bp, synthetic construct; identical to SEQ ID NO: 17850
  source 1..55: mol_type = other DNA

SEQ ID NO: 17854 - DNA, 55 bp, synthetic construct; identical to SEQ ID NO: 17850
  source 1..55: mol_type = other DNA

SEQ ID NO: 17855 - DNA, 58 bp, synthetic construct
  source 1..58: mol_type = other DNA
tgttctcagttttcctggattatgcctggcaccattaaagaaaatatcatctttggtg

SEQ ID NO: 17856 - DNA, 56 bp, synthetic construct
  source 1..56: mol_type = other DNA
gcatgctttgatgacgcttctgtatctatattcatcataggaaacaccaaagatga

SEQ ID NO: 17857 - DNA, 56 bp, synthetic construct; identical to SEQ ID NO: 17856
  source 1..56: mol_type = other DNA

SEQ ID NO: 17858 - DNA, 56 bp, synthetic construct; identical to SEQ ID NO: 17856
  source 1..56: mol_type = other DNA

SEQ ID NO: 17859 - DNA, 56 bp, synthetic construct; identical to SEQ ID NO: 17856
  source 1..56: mol_type = other DNA

SEQ ID NO: 17860 - DNA, 59 bp, synthetic construct
  source 1..59: mol_type = other DNA
tgttctcagttttcctggattatgcctggcaccattaaagaaaatatcatctttggtgt

SEQ ID NO: 17861 - DNA, 57 bp, synthetic construct
  source 1..57: mol_type = other DNA
gcatgctttgatgacgcttctgtatctatattcatcataggaaacaccaaagatgat

SEQ ID NO: 17862 - DNA, 57 bp, synthetic construct; identical to SEQ ID NO: 17861
  source 1..57: mol_type = other DNA

SEQ ID NO: 17863 - DNA, 60 bp, synthetic construct
  source 1..60: mol_type = other DNA
tgttctcagttttcctggattatgcctggcaccattaaagaaaatatcatctttggtgtt

SEQ ID NO: 17864 - DNA, 60 bp, synthetic construct; identical to SEQ ID NO: 17863
  source 1..60: mol_type = other DNA

SEQ ID NO: 17865 - DNA, 57 bp, synthetic construct; identical to SEQ ID NO: 17861
  source 1..57: mol_type = other DNA

SEQ ID NO: 17866 - DNA, 60 bp, synthetic construct; identical to SEQ ID NO: 17863
  source 1..60: mol_type = other DNA

SEQ ID NO: 17867 - DNA, 58 bp, synthetic construct
  source 1..58: mol_type = other DNA
gcatgctttgatgacgcttctgtatctatattcatcataggaaacaccaaagatgata

SEQ ID NO: 17868 - DNA, 61 bp, synthetic construct
  source 1..61: mol_type = other DNA
tgttctcagttttcctggattatgcctggcaccattaaagaaaatatcatctttggtgttt

SEQ ID NO: 17869 - DNA, 59 bp, synthetic construct
  source 1..59: mol_type = other DNA
gcatgctttgatgacgcttctgtatctatattcatcataggaaacaccaaagatgatat

SEQ ID NO: 17870 - DNA, 62 bp, synthetic construct
  source 1..62: mol_type = other DNA
tgttctcagttttcctggattatgcctggcaccattaaagaaaatatcatctttggtgtttc

SEQ ID NO: 17871 - DNA, 62 bp, synthetic construct; identical to SEQ ID NO: 17870
  source 1..62: mol_type = other DNA

SEQ ID NO: 17872 - DNA, 62 bp, synthetic construct; identical to SEQ ID NO: 17870
  source 1..62: mol_type = other DNA

SEQ ID NO: 17873 - DNA, 63 bp, synthetic construct
  source 1..63: mol_type = other DNA
tgttctcagttttcctggattatgcctggcaccattaaagaaaatatcatctttggtgtttcc

SEQ ID NO: 17874 - DNA, 60 bp, synthetic construct
  source 1..60: mol_type = other DNA
gcatgctttgatgacgcttctgtatctatattcatcataggaaacaccaaagatgatatt

SEQ ID NO: 17875 - DNA, 63 bp, synthetic construct; identical to SEQ ID NO: 17873
  source 1..63: mol_type = other DNA

SEQ ID NO: 17876 - DNA, 63 bp, synthetic construct; identical to SEQ ID NO: 17873
  source 1..63: mol_type = other DNA

SEQ ID NO: 17877 - DNA, 63 bp, synthetic construct; identical to SEQ ID NO: 17873
  source 1..63: mol_type = other DNA

SEQ ID NO: 17878 - DNA, 63 bp, synthetic construct; identical to SEQ ID NO: 17873
  source 1..63: mol_type = other DNA

SEQ ID NO: 17879 - DNA, 61 bp, synthetic construct
  source 1..61: mol_type = other DNA
gcatgctttgatgacgcttctgtatctatattcatcataggaaacaccaaagatgatattt

SEQ ID NO: 17880 - DNA, 61 bp, synthetic construct; identical to SEQ ID NO: 17879
  source 1..61: mol_type = other DNA

SEQ ID NO: 17881 - DNA, 64 bp, synthetic construct
  source 1..64: mol_type = other DNA
tgttctcagttttcctggattatgcctggcaccattaaagaaaatatcatctttggtgtttcct

SEQ ID NO: 17882 - DNA, 62 bp, synthetic construct
  source 1..62: mol_type = other DNA
gcatgctttgatgacgcttctgtatctatattcatcataggaaacaccaaagatgatatttt

SEQ ID NO: 17883 - DNA, 65 bp, synthetic construct
  source 1..65: mol_type = other DNA
tgttctcagttttcctggattatgcctggcaccattaaagaaaatatcatctttggtgtttccta

SEQ ID NO: 17884 - DNA, 62 bp, synthetic construct; identical to SEQ ID NO: 17882
  source 1..62: mol_type = other DNA

SEQ ID NO: 17885 - DNA, 62 bp, synthetic construct; identical to SEQ ID NO: 17882
  source 1..62: mol_type = other DNA

SEQ ID NO: 17886 - DNA, 65 bp, synthetic construct; identical to SEQ ID NO: 17883
  source 1..65: mol_type = other DNA

SEQ ID NO: 17887 - DNA, 66 bp, synthetic construct
  source 1..66: mol_type = other DNA
tgttctcagttttcctggattatgcctggcaccattaaagaaaatatcatctttggtgtttcctat

SEQ ID NO: 17888 - DNA, 66 bp, synthetic construct; identical to SEQ ID NO: 17887
  source 1..66: mol_type = other DNA

SEQ ID NO: 17889 - DNA, 63 bp, synthetic construct
  source 1..63: mol_type = other DNA
gcatgctttgatgacgcttctgtatctatattcatcataggaaacaccaaagatgatattttc

SEQ ID NO: 17890 - DNA, 66 bp, synthetic construct; identical to SEQ ID NO: 17887
  source 1..66: mol_type = other DNA

SEQ ID NO: 17891 - DNA, 67 bp, synthetic construct
  source 1..67: mol_type = other DNA
tgttctcagttttcctggattatgcctggcaccattaaagaaaatatcatctttggtgtttcctatg

SEQ ID NO: 17892 - DNA, 67 bp, synthetic construct; identical to SEQ ID NO: 17891
  source 1..67: mol_type = other DNA

SEQ ID NO: 17893 - DNA, 67 bp, synthetic construct; identical to SEQ ID NO: 17891
  source 1..67: mol_type = other DNA

SEQ ID NO: 17894 - DNA, 67 bp, synthetic construct; identical to SEQ ID NO: 17891
  source 1..67: mol_type = other DNA

SEQ ID NO: 17895 - DNA, 67 bp, synthetic construct; identical to SEQ ID NO: 17891
  source 1..67: mol_type = other DNA

SEQ ID NO: 17896 - DNA, 64 bp, synthetic construct
  source 1..64: mol_type = other DNA
gcatgctttgatgacgcttctgtatctatattcatcataggaaacaccaaagatgatattttct

SEQ ID NO: 17897 - DNA, 67 bp, synthetic construct; identical to SEQ ID NO: 17891
  source 1..67: mol_type = other DNA

SEQ ID NO: 17898 - DNA, 68 bp, synthetic construct
  source 1..68: mol_type = other DNA
tgttctcagttttcctggattatgcctggcaccattaaagaaaatatcatctttggtgtttcctatga

SEQ ID NO: 17899 - DNA, 68 bp, synthetic construct; identical to SEQ ID NO: 17898
  source 1..68: mol_type = other DNA

SEQ ID NO: 17900 - DNA, 68 bp, synthetic construct; identical to SEQ ID NO: 17898
  source 1..68: mol_type = other DNA

SEQ ID NO: 17901 - DNA, 68 bp, synthetic construct; identical to SEQ ID NO: 17898
  source 1..68: mol_type = other DNA

SEQ ID NO: 17902 - DNA, 68 bp, synthetic construct; identical to SEQ ID NO: 17898
  source 1..68: mol_type = other DNA

SEQ ID NO: 17903 - DNA, 65 bp, synthetic construct
  source 1..65: mol_type = other DNA
gcatgctttgatgacgcttctgtatctatattcatcataggaaacaccaaagatgatattttctt

SEQ ID NO: 17904 - DNA, 68 bp, synthetic construct; identical to SEQ ID NO: 17898
  source 1..68: mol_type = other DNA

SEQ ID NO: 17905 - DNA, 68 bp, synthetic construct; identical to SEQ ID NO: 17898
  source 1..68: mol_type = other DNA

SEQ ID NO: 17906 - DNA, 66 bp, synthetic construct
  source 1..66: mol_type = other DNA
gcatgctttgatgacgcttctgtatctatattcatcataggaaacaccaaagatgatattttcttt

SEQ ID NO: 17907 - DNA, 66 bp, synthetic construct; identical to SEQ ID NO: 17906
  source 1..66: mol_type = other DNA

SEQ ID NO: 17908 - DNA, 69 bp, synthetic construct
  source 1..69: mol_type = other DNA
tgttctcagttttcctggattatgcctggcaccattaaagaaaatatcatctttggtgtttcctatgat

SEQ ID NO: 17909 - DNA, 69 bp, synthetic construct; identical to SEQ ID NO: 17908
  source 1..69: mol_type = other DNA

SEQ ID NO: 17910 - DNA, 66 bp, synthetic construct; identical to SEQ ID NO: 17906
  source 1..66: mol_type = other DNA

SEQ ID NO: 17911 - DNA, 69 bp, synthetic construct; identical to SEQ ID NO: 17908
  source 1..69: mol_type = other DNA

SEQ ID NO: 17912 - DNA, 69 bp, synthetic construct; identical to SEQ ID NO: 17908
  source 1..69: mol_type = other DNA

SEQ ID NO: 17913 - DNA, 67 bp, synthetic construct
  source 1..67: mol_type = other DNA
gcatgctttgatgacgcttctgtatctatattcatcataggaaacaccaaagatgatattttcttta

SEQ ID NO: 17914 - DNA, 70 bp, synthetic construct
  source 1..70: mol_type = other DNA
tgttctcagttttcctggattatgcctggcaccattaaagaaaatatcatctttggtgtttcctatgatg

SEQ ID NO: 17915 - DNA, 67 bp, synthetic construct; identical to SEQ ID NO: 17913
  source 1..67: mol_type = other DNA

SEQ ID NO: 17916 - DNA, 67 bp, synthetic construct; identical to SEQ ID NO: 17913
  source 1..67: mol_type = other DNA

SEQ ID NO: 17917 - DNA, 70 bp, synthetic construct; identical to SEQ ID NO: 17914
  source 1..70: mol_type = other DNA

SEQ ID NO: 17918 - DNA, 68 bp, synthetic construct
  source 1..68: mol_type = other DNA
gcatgctttgatgacgcttctgtatctatattcatcataggaaacaccaaagatgatattttctttaa

SEQ ID NO: 17919 - DNA, 68 bp, synthetic construct; identical to SEQ ID NO: 17918
  source 1..68: mol_type = other DNA

SEQ ID NO: 17920 - DNA, 68 bp, synthetic construct; identical to SEQ ID NO: 17918
  source 1..68: mol_type = other DNA

SEQ ID NO: 17921 - DNA, 68 bp, synthetic construct; identical to SEQ ID NO: 17918
  source 1..68: mol_type = other DNA

SEQ ID NO: 17922 - DNA, 71 bp, synthetic construct
  source 1..71: mol_type = other DNA
tgttctcagttttcctggattatgcctggcaccattaaagaaaatatcatctttggtgtttcctatgatga

SEQ ID NO: 17923 - DNA, 69 bp, synthetic construct
  source 1..69: mol_type = other DNA
gcatgctttgatgacgcttctgtatctatattcatcataggaaacaccaaagatgatattttctttaat

SEQ ID NO: 17924 - DNA, 69 bp, synthetic construct; identical to SEQ ID NO: 17923
  source 1..69: mol_type = other DNA

SEQ ID NO: 17925 - DNA, 69 bp, synthetic construct; identical to SEQ ID NO: 17923
  source 1..69: mol_type = other DNA

SEQ ID NO: 17926 - DNA, 72 bp, synthetic construct
  source 1..72: mol_type = other DNA
tgttctcagttttcctggattatgcctggcaccattaaagaaaatatcatctttggtgtttcctatgatgaa

SEQ ID NO: 17927 - DNA, 69 bp, synthetic construct; identical to SEQ ID NO: 17923
  source 1..69: mol_type = other DNA

SEQ ID NO: 17928 - DNA, 70 bp, synthetic construct
  source 1..70: mol_type = other DNA
gcatgctttgatgacgcttctgtatctatattcatcataggaaacaccaaagatgatattttctttaatg

SEQ ID NO: 17929 - DNA, 70 bp, synthetic construct; identical to SEQ ID NO: 17928
  source 1..70: mol_type = other DNA

SEQ ID NO: 17930 - DNA, 73 bp, synthetic construct
  source 1..73: mol_type = other DNA
tgttctcagttttcctggattatgcctggcaccattaaagaaaatatcatctttggtgtttcctatgatgaat

SEQ ID NO: 17931 - DNA, 71 bp, synthetic construct
  source 1..71: mol_type = other DNA
gcatgctttgatgacgcttctgtatctatattcatcataggaaacaccaaagatgatattttctttaatgg

SEQ ID NO: 17932 - DNA, 71 bp, synthetic construct; identical to SEQ ID NO: 17931
  source 1..71: mol_type = other DNA

SEQ ID NO: 17933 - DNA, 74 bp, synthetic construct
  source 1..74: mol_type = other DNA
tgttctcagttttcctggattatgcctggcaccattaaagaaaatatcatctttggtgtttcctatgatgaata

SEQ ID NO: 17934 - DNA, 74 bp, synthetic construct; identical to SEQ ID NO: 17933
  source 1..74: mol_type = other DNA

SEQ ID NO: 17935 - DNA, 74 bp, synthetic construct; identical to SEQ ID NO: 17933
  source 1..74: mol_type = other DNA

SEQ ID NO: 17936 - DNA, 72 bp, synthetic construct
  source 1..72: mol_type = other DNA
gcatgctttgatgacgcttctgtatctatattcatcataggaaacaccaaagatgatattttctttaatggt

SEQ ID NO: 17937 - DNA, 72 bp, synthetic construct; identical to SEQ ID NO: 17936
  source 1..72: mol_type = other DNA

SEQ ID NO: 17938 - DNA, 75 bp, synthetic construct
  source 1..75: mol_type = other DNA
tgttctcagttttcctggattatgcctggcaccattaaagaaaatatcatctttggtgtttcctatgatgaatat

SEQ ID NO: 17939 - DNA, 73 bp, synthetic construct
  source 1..73: mol_type = other DNA
gcatgctttgatgacgcttctgtatctatattcatcataggaaacaccaaagatgatattttctttaatggtg

SEQ ID NO: 17940 - DNA, 76 bp, synthetic construct
  source 1..76: mol_type = other DNA
tgttctcagttttcctggattatgcctggcaccattaaagaaaatatcatctttggtgtttcctatgatgaatata

SEQ ID NO: 17941 - DNA, 74 bp, synthetic construct
  source 1..74: mol_type = other DNA
gcatgctttgatgacgcttctgtatctatattcatcataggaaacaccaaagatgatattttctttaatggtgc

SEQ ID NO: 17942 - DNA, 77 bp, synthetic construct
  source 1..77: mol_type = other DNA
tgttctcagttttcctggattatgcctggcaccattaaagaaaatatcatctttggtgtttcctatgatgaatatag

SEQ ID NO: 17943 - DNA, 77 bp, synthetic construct; identical to SEQ ID NO: 17942
  source 1..77: mol_type = other DNA

SEQ ID NO: 17944 - DNA, 75 bp, synthetic construct
  source 1..75: mol_type = other DNA
gcatgctttgatgacgcttctgtatctatattcatcataggaaacaccaaagatgatattttctttaatggtgcc

SEQ ID NO: 17945 - DNA, 78 bp, synthetic construct
  source 1..78: mol_type = other DNA
tgttctcagttttcctggattatgcctggcaccattaaagaaaatatcatctttggtgtttcctatgatgaatataga

SEQ ID NO: 17946 - DNA, 76 bp, synthetic construct
  source 1..76: mol_type = other DNA
gcatgctttgatgacgcttctgtatctatattcatcataggaaacaccaaagatgatattttctttaatggtgcca

SEQ ID NO: 17947 - DNA, 76 bp, synthetic construct; identical to SEQ ID NO: 17946
  source 1..76: mol_type = other DNA

SEQ ID NO: 17948 - DNA, 79 bp, synthetic construct
  source 1..79: mol_type = other DNA
tgttctcagttttcctggattatgcctggcaccattaaagaaaatatcatctttggtgtttcctatgatgaatatagat

SEQ ID NO: 17949 - DNA, 80 bp, synthetic construct
  source 1..80: mol_type = other DNA
tgttctcagttttcctggattatgcctggcaccattaaagaaaatatcatctttggtgtttcctatgatgaatatagata

SEQ ID NO: 17950 - DNA, 77 bp, synthetic construct
  source 1..77: mol_type = other DNA
gcatgctttgatgacgcttctgtatctatattcatcataggaaacaccaaagatgatattttctttaatggtgccag

SEQ ID NO: 17951 - DNA, 80 bp, synthetic construct; identical to SEQ ID NO: 17949
  source 1..80: mol_type = other DNA

SEQ ID NO: 17952 - DNA, 77 bp, synthetic construct; identical to SEQ ID NO: 17950
  source 1..77: mol_type = other DNA

SEQ ID NO: 17953 - DNA, 77 bp, synthetic construct; identical to SEQ ID NO: 17950
  source 1..77: mol_type = other DNA

SEQ ID NO: 17954 - DNA, 78 bp, synthetic construct
  source 1..78: mol_type = other DNA
gcatgctttgatgacgcttctgtatctatattcatcataggaaacaccaaagatgatattttctttaatggtgccagg

SEQ ID NO: 17955 - DNA, 78 bp, synthetic construct; identical to SEQ ID NO: 17954
  source 1..78: mol_type = other DNA

SEQ ID NO: 17956 - DNA, 78 bp, synthetic construct; identical to SEQ ID NO: 17954
  source 1..78: mol_type = other DNA

SEQ ID NO: 17957 - DNA, 81 bp, synthetic construct
  source 1..81: mol_type = other DNA
tgttctcagttttcctggattatgcctggcaccattaaagaaaatatcatctttggtgtttcctatgatgaatatagatac

SEQ ID NO: 17958 - DNA, 78 bp, synthetic construct; identical to SEQ ID NO: 17954
  source 1..78: mol_type = other DNA

SEQ ID NO: 17959 - DNA, 78 bp, synthetic construct; identical to SEQ ID NO: 17954
  source 1..78: mol_type = other DNA

SEQ ID NO: 17960 - DNA, 79 bp, synthetic construct
  source 1..79: mol_type = other DNA
gcatgctttgatgacgcttctgtatctatattcatcataggaaacaccaaagatgatattttctttaatggtgccaggc

SEQ ID NO: 17961 - DNA, 79 bp, synthetic construct; identical to SEQ ID NO: 17960
  source 1..79: mol_type = other DNA

SEQ ID NO: 17962 - DNA, 79 bp, synthetic construct; identical to SEQ ID NO: 17960
  source 1..79: mol_type = other DNA

SEQ ID NO: 17963 - DNA, 79 bp, synthetic construct; identical to SEQ ID NO: 17960
  source 1..79: mol_type = other DNA

SEQ ID NO: 17964 - DNA, 82 bp, synthetic construct
  source 1..82: mol_type = other DNA
tgttctcagttttcctggattatgcctggcaccattaaagaaaatatcatctttggtgtttcctatgatgaatatagataca

SEQ ID NO: 17965 - DNA, 80 bp, synthetic construct
  source 1..80: mol_type = other DNA
gcatgctttgatgacgcttctgtatctatattcatcataggaaacaccaaagatgatattttctttaatggtgccaggca

SEQ ID NO: 17966 - DNA, 80 bp, synthetic construct; identical to SEQ ID NO: 17965
  source 1..80: mol_type = other DNA

SEQ ID NO: 17967 - DNA, 80 bp, synthetic construct; identical to SEQ ID NO: 17965
  source 1..80: mol_type = other DNA

SEQ ID NO: 17968 - DNA, 80 bp, synthetic construct; identical to SEQ ID NO: 17965
  source 1..80: mol_type = other DNA

SEQ ID NO: 17969 - DNA, 83 bp, synthetic construct
  source 1..83: mol_type = other DNA
tgttctcagttttcctggattatgcctggcaccattaaagaaaatatcatctttggtgtttcctatgatgaatatagatacag

SEQ ID NO: 17970 - DNA, 80 bp, synthetic construct; identical to SEQ ID NO: 17965
  source 1..80: mol_type = other DNA

SEQ ID NO: 17971 - DNA, 81 bp, synthetic construct
  source 1..81: mol_type = other DNA
gcatgctttgatgacgcttctgtatctatattcatcataggaaacaccaaagatgatattttctttaatggtgccaggcat

SEQ ID NO: 17972 - DNA, 81 bp, synthetic construct; identical to SEQ ID NO: 17971
  source 1..81: mol_type = other DNA

SEQ ID NO: 17973 - DNA, 84 bp, synthetic construct
  source 1..84: mol_type = other DNA
tgttctcagttttcctggattatgcctggcaccattaaagaaaatatcatctttggtgtttcctatgatgaatatagatacaga

SEQ ID NO: 17974 - DNA, 84 bp, synthetic construct; identical to SEQ ID NO: 17973
  source 1..84: mol_type = other DNA

SEQ ID NO: 17975 - DNA, 84 bp, synthetic construct; identical to SEQ ID NO: 17973
  source 1..84: mol_type = other DNA

SEQ ID NO: 17976 - DNA, 85 bp, synthetic construct
  source 1..85: mol_type = other DNA
tgttctcagttttcctggattatgcctggcaccattaaagaaaatatcatctttggtgtttcctatgatgaatatagatacagaa

SEQ ID NO: 17977 - DNA, 82 bp, synthetic construct
  source 1..82: mol_type = other DNA
gcatgctttgatgacgcttctgtatctatattcatcataggaaacaccaaagatgatattttctttaatggtgccaggcata

SEQ ID NO: 17978 - DNA, 85 bp, synthetic construct; identical to SEQ ID NO: 17976
  source 1..85: mol_type = other DNA

SEQ ID NO: 17979 - DNA, 17 bp, synthetic construct
  source 1..17: mol_type = other DNA
tgatattttctttaatg

SEQ ID NO: 17980 - DNA, 17 bp, synthetic construct
  source 1..17: mol_type = other DNA
tgtttcctatgatgaat

SEQ ID NO: 17981 - DNA, 17 bp, synthetic construct
  source 1..17: mol_type = other DNA
tgatattttctttaatg

SEQ ID NO: 17982 - DNA, 17 bp, synthetic construct
  source 1..17: mol_type = other DNA
tgtttcctatgatgaat

SEQ ID NO: 17983 - DNA, 17 bp, synthetic construct
  source 1..17: mol_type = other DNA
gtttcctatgatgaata

SEQ ID NO: 17984 - DNA, 17 bp, synthetic construct
  source 1..17: mol_type = other DNA
gtttcctatgatgaata

SEQ ID NO: 17985 - DNA, 17 bp, synthetic construct
  source 1..17: mol_type = other DNA
gatattttctttaatgg

SEQ ID NO: 17986 - DNA, 17 bp, synthetic construct
  source 1..17: mol_type = other DNA
gatattttctttaatgg

SEQ ID NO: 17987 - DNA, 17 bp, synthetic construct
  source 1..17: mol_type = other DNA
gtttcctatgatgaata

SEQ ID NO: 17988 - DNA, 17 bp, synthetic construct
  source 1..17: mol_type = other DNA
atattttctttaatggt

SEQ ID NO: 17989 - DNA, 17 bp, synthetic construct
  source 1..17: mol_type = other DNA
atattttctttaatggt

SEQ ID NO: 17990 - DNA, 17 bp, synthetic construct
  source 1..17: mol_type = other DNA
atattttctttaatggt

SEQ ID NO: 17991 - DNA, 17 bp, synthetic construct
  source 1..17: mol_type = other DNA
atattttctttaatggt

SEQ ID NO: 17992 - DNA, 17 bp, synthetic construct
  source 1..17: mol_type = other DNA
atattttctttaatggt

SEQ ID NO: 17993 - DNA, 17 bp, synthetic construct
  source 1..17: mol_type = other DNA
tttcctatgatgaatat

SEQ ID NO: 17994 - DNA, 17 bp, synthetic construct
  source 1..17: mol_type = other DNA
tattttctttaatggtg

SEQ ID NO: 17995 - DNA, 17 bp, synthetic construct
  source 1..17: mol_type = other DNA
tattttctttaatggtg

SEQ ID NO: 17996 - DNA, 17 bp, synthetic construct
  source 1..17: mol_type = other DNA
tattttctttaatggtg

SEQ ID NO: 17997 - DNA, 17 bp, synthetic construct
  source 1..17: mol_type = other DNA
tattttctttaatggtg

SEQ ID NO: 17998 - DNA, 17 bp, synthetic construct
  source 1..17: mol_type = other DNA
ttcctatgatgaatata

SEQ ID NO: 17999 - DNA, 17 bp, synthetic construct
  source 1..17: mol_type = other DNA
attttctttaatggtgc

SEQ ID NO: 18000 - DNA, 17 bp, synthetic construct
  source 1..17: mol_type = other DNA
attttctttaatggtgc

SEQ ID NO: 18001 - DNA, 17 bp, synthetic construct
  source 1..17: mol_type = other DNA
tcctatgatgaatatag

SEQ ID NO: 18002 - DNA, 17 bp, synthetic construct
  source 1..17: mol_type = other DNA
tcctatgatgaatatag

SEQ ID NO: 18003 - DNA, 17 bp, synthetic construct
  source 1..17: mol_type = other DNA
attttctttaatggtgc

SEQ ID NO: 18004 - DNA, 17 bp, synthetic construct
  source 1..17: mol_type = other DNA
tcctatgatgaatatag

SEQ ID NO: 18005 - DNA, 17 bp, synthetic construct
  source 1..17: mol_type = other DNA
ttttctttaatggtgcc

SEQ ID NO: 18006 - DNA, 17 bp, synthetic construct
  source 1..17: mol_type = other DNA
cctatgatgaatataga

SEQ ID NO: 18007 - DNA, 17 bp, synthetic construct
  source 1..17: mol_type = other DNA
tttctttaatggtgcca

SEQ ID NO: 18008 - DNA, 17 bp, synthetic construct
  source 1..17: mol_type = other DNA
ctatgatgaatatagat

SEQ ID NO: 18009 - DNA, 17 bp, synthetic construct
  source 1..17: mol_type = other DNA
ctatgatgaatatagat

SEQ ID NO: 18010 - DNA, 17 bp, synthetic construct
  source 1..17: mol_type = other DNA
ctatgatgaatatagat

SEQ ID NO: 18011 - DNA, 17 bp, synthetic construct
  source 1..17: mol_type = other DNA
tatgatgaatatagata

SEQ ID NO: 18012 - DNA, 17 bp, synthetic construct
  source 1..17: mol_type = other DNA
ttctttaatggtgccag

SEQ ID NO: 18013 - DNA, 17 bp, synthetic construct
  source 1..17: mol_type = other DNA
tatgatgaatatagata

SEQ ID NO: 18014 - DNA, 17 bp, synthetic construct
  source 1..17: mol_type = other DNA
tatgatgaatatagata

SEQ ID NO: 18015 - DNA, 17 bp, synthetic construct
  source 1..17: mol_type = other DNA
tatgatgaatatagata

SEQ ID NO: 18016 - DNA, 17 bp, synthetic construct
  source 1..17: mol_type = other DNA
tatgatgaatatagata

SEQ ID NO: 18017 - DNA, 17 bp, synthetic construct
  source 1..17: mol_type = other DNA
tctttaatggtgccagg

SEQ ID NO: 18018 - DNA, 17 bp, synthetic construct
  source 1..17: mol_type = other DNA
tctttaatggtgccagg

SEQ ID NO: 18019 - DNA, 17 bp, synthetic construct
  source 1..17: mol_type = other DNA
atgatgaatatagatac

SEQ ID NO: 18020 - DNA, 17 bp, synthetic construct
  source 1..17: mol_type = other DNA
ctttaatggtgccaggc

SEQ ID NO: 18021 - DNA, 17 bp, synthetic construct
  source 1..17: mol_type = other DNA
tgatgaatatagataca

SEQ ID NO: 18022 - DNA, 17 bp, synthetic construct
  source 1..17: mol_type = other DNA
ctttaatggtgccaggc

SEQ ID NO: 18023 - DNA, 17 bp, synthetic construct
  source 1..17: mol_type = other DNA
ctttaatggtgccaggc

SEQ ID NO: 18024 - DNA, 17 bp, synthetic construct
  source 1..17: mol_type = other DNA
tgatgaatatagataca

SEQ ID NO: 18025 - DNA, 17 bp, synthetic construct
  source 1..17: mol_type = other DNA
gatgaatatagatacag

SEQ ID NO: 18026 - DNA, 17 bp, synthetic construct
  source 1..17: mol_type = other DNA
gatgaatatagatacag

SEQ ID NO: 18027 - DNA, 17 bp, synthetic construct
  source 1..17: mol_type = other DNA
tttaatggtgccaggca

SEQ ID NO: 18028 - DNA, 17 bp, synthetic construct
  source 1..17: mol_type = other DNA
gatgaatatagatacag

SEQ ID NO: 18029 - DNA, 17 bp, synthetic construct
  source 1..17: mol_type = other DNA
atgaatatagatacaga

SEQ ID NO: 18030 - DNA, 17 bp, synthetic construct
  source 1..17: mol_type = other DNA
atgaatatagatacaga

SEQ ID NO: 18031 - DNA, 17 bp, synthetic construct
  source 1..17: mol_type = other DNA
atgaatatagatacaga

SEQ ID NO: 18032 - DNA, 17 bp, synthetic construct
  source 1..17: mol_type = other DNA
atgaatatagatacaga

SEQ ID NO: 18033 - DNA, 17 bp, synthetic construct
  source 1..17: mol_type = other DNA
atgaatatagatacaga

SEQ ID NO: 18034 - DNA, 17 bp, synthetic construct
  source 1..17: mol_type = other DNA
ttaatggtgccaggcat

SEQ ID NO: 18035 - DNA, 17 bp, synthetic construct
  source 1..17: mol_type = other DNA
atgaatatagatacaga

SEQ ID NO: 18036 - DNA, 17 bp, synthetic construct
  source 1..17: mol_type = other DNA
tgaatatagatacagaa

SEQ ID NO: 18037 - DNA, 17 bp, synthetic construct
  source 1..17: mol_type = other DNA
tgaatatagatacagaa

SEQ ID NO: 18038 - DNA, 17 bp, synthetic construct
  source 1..17: mol_type = other DNA
tgaatatagatacagaa

SEQ ID NO: 18039 - DNA, 17 bp, synthetic construct
  source 1..17: mol_type = other DNA
tgaatatagatacagaa

SEQ ID NO: 18040 - DNA, 17 bp, synthetic construct
  source 1..17: mol_type = other DNA
tgaatatagatacagaa

SEQ ID NO: 18041 - DNA, 17 bp, synthetic construct
  source 1..17: mol_type = other DNA
taatggtgccaggcata

SEQ ID NO: 18042 - DNA, 17 bp, synthetic construct
  source 1..17: mol_type = other DNA
tgaatatagatacagaa

SEQ ID NO: 18043 - DNA, 17 bp, synthetic construct
  source 1..17: mol_type = other DNA
tgaatatagatacagaa

SEQ ID NO: 18044 - DNA, 17 bp, synthetic construct
  source 1..17: mol_type = other DNA
aatggtgccaggcataa

SEQ ID NO: 18045 - DNA, 17 bp, synthetic construct
  source 1..17: mol_type = other DNA
aatggtgccaggcataa

SEQ ID NO: 18046 - DNA, 17 bp, synthetic construct
  source 1..17: mol_type = other DNA
gaatatagatacagaag

SEQ ID NO: 18047 - DNA, 17 bp, synthetic construct
  source 1..17: mol_type = other DNA
gaatatagatacagaag

SEQ ID NO: 18048 - DNA, 17 bp, synthetic construct
  source 1..17: mol_type = other DNA
aatggtgccaggcataa

SEQ ID NO: 18049 - DNA, 17 bp, synthetic construct
  source 1..17: mol_type = other DNA
gaatatagatacagaag

SEQ ID NO: 18050 - DNA, 17 bp, synthetic construct
  source 1..17: mol_type = other DNA
gaatatagatacagaag

SEQ ID NO: 18051 - DNA, 17 bp, synthetic construct
  source 1..17: mol_type = other DNA
atggtgccaggcataat

SEQ ID NO: 18052 - DNA, 17 bp, synthetic construct
  source 1..17: mol_type = other DNA
aatatagatacagaagc

SEQ ID NO: 18053 - DNA, 17 bp, synthetic construct
  source 1..17: mol_type = other DNA
atggtgccaggcataat

SEQ ID NO: 18054 - DNA, 17 bp, synthetic construct
  source 1..17: mol_type = other DNA
atggtgccaggcataat

SEQ ID NO: 18055 - DNA, 17 bp, synthetic construct
  source 1..17: mol_type = other DNA
aatatagatacagaagc

SEQ ID NO: 18056 - DNA, 17 bp, synthetic construct
  source 1..17: mol_type = other DNA
tggtgccaggcataatc

SEQ ID NO: 18057 - DNA, 17 bp, synthetic construct
  source 1..17: mol_type = other DNA
tggtgccaggcataatc

SEQ ID NO: 18058 - DNA, 17 bp, synthetic construct
  source 1..17: mol_type = other DNA
tggtgccaggcataatc

SEQ ID NO: 18059 - DNA, 17 bp, synthetic construct
  source 1..17: mol_type = other DNA
tggtgccaggcataatc

SEQ ID NO: 18060 - DNA, 17 bp, synthetic construct
  source 1..17: mol_type = other DNA
atatagatacagaagcg

SEQ ID NO: 18061 - DNA, 17 bp, synthetic construct
  source 1..17: mol_type = other DNA
ggtgccaggcataatcc

SEQ ID NO: 18062 - DNA, 17 bp, synthetic construct
  source 1..17: mol_type = other DNA
ggtgccaggcataatcc

SEQ ID NO: 18063 - DNA, 17 bp, synthetic construct
  source 1..17: mol_type = other DNA
ggtgccaggcataatcc

SEQ ID NO: 18064 - DNA, 17 bp, synthetic construct
  source 1..17: mol_type = other DNA
tatagatacagaagcgt

SEQ ID NO: 18065 - DNA, 17 bp, synthetic construct
  source 1..17: mol_type = other DNA
ggtgccaggcataatcc

SEQ ID NO: 18066 - DNA, 17 bp, synthetic construct
  source 1..17: mol_type = other DNA
gtgccaggcataatcca

SEQ ID NO: 18067 - DNA, 17 bp, synthetic construct
  source 1..17: mol_type = other DNA
gtgccaggcataatcca

SEQ ID NO: 18068 - DNA, 17 bp, synthetic construct
  source 1..17: mol_type = other DNA
atagatacagaagcgtc

SEQ ID NO: 18069 - DNA, 17 bp, synthetic construct
  source 1..17: mol_type = other DNA
tgccaggcataatccag

SEQ ID NO: 18070 - DNA, 17 bp, synthetic construct
  source 1..17: mol_type = other DNA
tgccaggcataatccag

SEQ ID NO: 18071 - DNA, 17 bp, synthetic construct
  source 1..17: mol_type = other DNA
tagatacagaagcgtca

SEQ ID NO: 18072 - DNA, 17 bp, synthetic construct
  source 1..17: mol_type = other DNA
tagatacagaagcgtca

SEQ ID NO: 18073 - DNA, 17 bp, synthetic construct
  source 1..17: mol_type = other DNA
tagatacagaagcgtca

SEQ ID NO: 18074 - DNA, 17 bp, synthetic construct
  source 1..17: mol_type = other DNA
gccaggcataatccagg

SEQ ID NO: 18075 - DNA, 17 bp, synthetic construct
  source 1..17: mol_type = other DNA
gccaggcataatccagg

SEQ ID NO: 18076 - DNA, 17 bp, synthetic construct
  source 1..17: mol_type = other DNA
agatacagaagcgtcat

SEQ ID NO: 18077 - DNA, 17 bp, synthetic construct
  source 1..17: mol_type = other DNA
ccaggcataatccagga

SEQ ID NO: 18078 - DNA, 17 bp, synthetic construct
  source 1..17: mol_type = other DNA
gatacagaagcgtcatc

SEQ ID NO: 18079 - DNA, 17 bp, synthetic construct
  source 1..17: mol_type = other DNA
caggcataatccaggaa

SEQ ID NO: 18080 - DNA, 17 bp, synthetic construct
  source 1..17: mol_type = other DNA
atacagaagcgtcatca

SEQ ID NO: 18081 - DNA, 17 bp, synthetic construct
  source 1..17: mol_type = other DNA
atacagaagcgtcatca

SEQ ID NO: 18082 - DNA, 17 bp, synthetic construct
  source 1..17: mol_type = other DNA
aggcataatccaggaaa

SEQ ID NO: 18083 - DNA, 17 bp, synthetic construct
  source 1..17: mol_type = other DNA
tacagaagcgtcatcaa

SEQ ID NO: 18084 - DNA, 17 bp, synthetic construct
  source 1..17: mol_type = other DNA
ggcataatccaggaaaa

SEQ ID NO: 18085 - DNA, 17 bp, synthetic construct
  source 1..17: mol_type = other DNA
ggcataatccaggaaaa

SEQ ID NO: 18086 - DNA, 17 bp, synthetic construct
  source 1..17: mol_type = other DNA
acagaagcgtcatcaaa

SEQ ID NO: 18087 - DNA, 17 bp, synthetic construct
  source 1..17: mol_type = other DNA
cagaagcgtcatcaaag

SEQ ID NO: 18088 - DNA, 17 bp, synthetic construct
  source 1..17: mol_type = other DNA
gcataatccaggaaaac

SEQ ID NO: 18089 - DNA, 17 bp, synthetic construct
  source 1..17: mol_type = other DNA
cagaagcgtcatcaaag

SEQ ID NO: 18090 - DNA, 17 bp, synthetic construct
  source 1..17: mol_type = other DNA
gcataatccaggaaaac

SEQ ID NO: 18091 - DNA, 17 bp, synthetic construct
  source 1..17: mol_type = other DNA
gcataatccaggaaaac

SEQ ID NO: 18092 - DNA, 17 bp, synthetic construct
  source 1..17: mol_type = other DNA
cataatccaggaaaact

SEQ ID NO: 18093 - DNA, 17 bp, synthetic construct
  source 1..17: mol_type = other DNA
cataatccaggaaaact

SEQ ID NO: 18094 - DNA, 17 bp, synthetic construct
  source 1..17: mol_type = other DNA
cataatccaggaaaact

SEQ ID NO: 18095 - DNA, 17 bp, synthetic construct
  source 1..17: mol_type = other DNA
agaagcgtcatcaaagc

SEQ ID NO: 18096 - DNA, 17 bp, synthetic construct
  source 1..17: mol_type = other DNA
cataatccaggaaaact

SEQ ID NO: 18097 - DNA, 17 bp, synthetic construct
  source 1..17: mol_type = other DNA
cataatccaggaaaact

SEQ ID NO: 18098 - DNA, 17 bp, synthetic construct
  source 1..17: mol_type = other DNA
ataatccaggaaaactg

SEQ ID NO: 18099 - DNA, 17 bp, synthetic construct
  source 1..17: mol_type = other DNA
ataatccaggaaaactg

SEQ ID NO: 18100 - DNA, 17 bp, synthetic construct
  source 1..17: mol_type = other DNA
ataatccaggaaaactg

SEQ ID NO: 18101 - DNA, 17 bp, synthetic construct
  source 1..17: mol_type = other DNA
ataatccaggaaaactg

SEQ ID NO: 18102 - DNA, 17 bp, synthetic construct
  source 1..17: mol_type = other DNA
gaagcgtcatcaaagca

SEQ ID NO: 18103 - DNA, 17 bp, synthetic construct
  source 1..17: mol_type = other DNA
taatccaggaaaactga

SEQ ID NO: 18104 - DNA, 17 bp, synthetic construct
  source 1..17: mol_type = other DNA
taatccaggaaaactga

SEQ ID NO: 18105 - DNA, 17 bp, synthetic construct
  source 1..17: mol_type = other DNA
taatccaggaaaactga

SEQ ID NO: 18106 - DNA, 17 bp, synthetic construct
  source 1..17: mol_type = other DNA
taatccaggaaaactga

SEQ ID NO: 18107 - DNA, 17 bp, synthetic construct
  source 1..17: mol_type = other DNA
aagcgtcatcaaagcat

SEQ ID NO: 18108 - DNA, 17 bp, synthetic construct
  source 1..17: mol_type = other DNA
taatccaggaaaactga

SEQ ID NO: 18109 - DNA, 17 bp, synthetic construct
  source 1..17: mol_type = other DNA
aatccaggaaaactgag

SEQ ID NO: 18110 - DNA, 17 bp, synthetic construct
  source 1..17: mol_type = other DNA
aatccaggaaaactgag

SEQ ID NO: 18111 - DNA, 17 bp, synthetic construct
  source 1..17: mol_type = other DNA
agcgtcatcaaagcatg

SEQ ID NO: 18112 - DNA, 17 bp, synthetic construct
  source 1..17: mol_type = other DNA
agcgtcatcaaagcatg

SEQ ID NO: 18113 - DNA, 17 bp, synthetic construct
  source 1..17: mol_type = other DNA
agcgtcatcaaagcatg

SEQ ID NO: 18114 - DNA, 17 bp, synthetic construct
  source 1..17: mol_type = other DNA
gcgtcatcaaagcatgc

SEQ ID NO: 18115 - DNA, 17 bp, synthetic construct
  source 1..17: mol_type = other DNA
atccaggaaaactgaga

SEQ ID NO: 18116 - DNA, 17 bp, synthetic construct
  source 1..17: mol_type = other DNA
gcgtcatcaaagcatgc

SEQ ID NO: 18117 - DNA, 20 bp, synthetic construct
  source 1..20: mol_type = other DNA
attttaccctctgaaggctc

SEQ ID NO: 18118 - DNA, 20 bp, synthetic construct
  source 1..20: mol_type = other DNA
tggtgattatgggagaactg

SEQ ID NO: 18119 - DNA, 20 bp, synthetic construct
  source 1..20: mol_type = other DNA
tctgaaggctccagttctcc

SEQ ID NO: 18120 - DNA, 20 bp, synthetic construct
  source 1..20: mol_type = other DNA
ggtgattatgggagaactgg

SEQ ID NO: 18121 - DNA, 21 bp, synthetic construct
  source 1..21: mol_type = other DNA
gattatgggagaactggagcc

SEQ ID NO: 18122 - DNA, 21 bp, synthetic construct
  source 1..21: mol_type = other DNA
gattatgggagaactggagcc

SEQ ID NO: 18123 - DNA, 20 bp, synthetic construct
  source 1..20: mol_type = other DNA
ttttaccctctgaaggctcc

SEQ ID NO: 18124 - DNA, 20 bp, synthetic construct
  source 1..20: mol_type = other DNA
ctgaaggctccagttctccc

SEQ ID NO: 18125 - DNA, 20 bp, synthetic construct
  source 1..20: mol_type = other DNA
gtgattatgggagaactgga

SEQ ID NO: 18126 - DNA, 24 bp, synthetic construct
  source 1..24: mol_type = other DNA
tgaaggctccagttctcccataat

SEQ ID NO: 18127 - DNA, 20 bp, synthetic construct
  source 1..20: mol_type = other DNA
agttctcccataatcaccat

SEQ ID NO: 18128 - DNA, 20 bp, synthetic construct
  source 1..20: mol_type = other DNA
tgcttaattttaccctctga

SEQ ID NO: 18129 - DNA, 20 bp, synthetic construct
  source 1..20: mol_type = other DNA
ttttaccctctgaaggctcc

SEQ ID NO: 18130 - DNA, 20 bp, synthetic construct
  source 1..20: mol_type = other DNA
tgaaggctccagttctccca

SEQ ID NO: 18131 - DNA, 20 bp, synthetic construct
  source 1..20: mol_type = other DNA
tgattatgggagaactggag

SEQ ID NO: 18132 - DNA, 21 bp, synthetic construct
  source 1..21: mol_type = other DNA
tgtgcttaattttaccctctg

SEQ ID NO: 18133 - DNA, 21 bp, synthetic construct
  source 1..21: mol_type = other DNA
ccagttctcccataatcacca

SEQ ID NO: 18134 - DNA, 20 bp, synthetic construct
  source 1..20: mol_type = other DNA
agttctcccataatcaccat

SEQ ID NO: 18135 - DNA, 20 bp, synthetic construct
  source 1..20: mol_type = other DNA
gaaggctccagttctcccat

SEQ ID NO: 18136 - DNA, 20 bp, synthetic construct
  source 1..20: mol_type = other DNA
gattatgggagaactggagc

SEQ ID NO: 18137 - DNA, 21 bp, synthetic construct
  source 1..21: mol_type = other DNA
ctctgaaggctccagttctcc

SEQ ID NO: 18138 - DNA, 21 bp, synthetic construct
  source 1..21: mol_type = other DNA
ctctgaaggctccagttctcc

SEQ ID NO: 18139 - DNA, 21 bp, synthetic construct
  source 1..21: mol_type = other DNA
gattatgggagaactggagcc

SEQ ID NO: 18140 - DNA, 21 bp, synthetic construct
  source 1..21: mol_type = other DNA
gattatgggagaactggagcc

SEQ ID NO: 18141 - DNA, 20 bp, synthetic construct
  source 1..20: mol_type = other DNA
aaggctccagttctcccata

SEQ ID NO: 18142 - DNA, 20 bp, synthetic construct
  source 1..20: mol_type = other DNA
attatgggagaactggagcc

SEQ ID NO: 18143 - DNA, 20 bp, synthetic construct
  source 1..20: mol_type = other DNA
aggctccagttctcccataa

SEQ ID NO: 18144 - DNA, 20 bp, synthetic construct
  source 1..20: mol_type = other DNA
ttatgggagaactggagcct

SEQ ID NO: 18145 - DNA, 20 bp, synthetic construct
  source 1..20: mol_type = other DNA
ggctccagttctcccataat

SEQ ID NO: 18146 - DNA, 20 bp, synthetic construct
  source 1..20: mol_type = other DNA
tatgggagaactggagcctt

SEQ ID NO: 18147 - DNA, 23 bp, synthetic construct
  source 1..23: mol_type = other DNA
tggtgattatgggagaactggag

SEQ ID NO: 18148 - DNA, 23 bp, synthetic construct
  source 1..23: mol_type = other DNA
tggtgattatgggagaactggag

SEQ ID NO: 18149 - DNA, 24 bp, synthetic construct
  source 1..24: mol_type = other DNA
tctaatggtgattatgggagaact

SEQ ID NO: 18150 - DNA, 20 bp, synthetic construct
  source 1..20: mol_type = other DNA
gctccagttctcccataatc

SEQ ID NO: 18151 - DNA, 20 bp, synthetic construct
  source 1..20: mol_type = other DNA
atgggagaactggagccttc

SEQ ID NO: 18152 - DNA, 23 bp, synthetic construct
  source 1..23: mol_type = other DNA
tggtgattatgggagaactggag

SEQ ID NO: 18153 - DNA, 23 bp, synthetic construct
  source 1..23: mol_type = other DNA
tggtgattatgggagaactggag

SEQ ID NO: 18154 - DNA, 23 bp, synthetic construct
  source 1..23: mol_type = other DNA
tggtgattatgggagaactggag

SEQ ID NO: 18155 - DNA, 24 bp, synthetic construct
  source 1..24: mol_type = other DNA
tgaaggctccagttctcccataat

SEQ ID NO: 18156 - DNA, 20 bp, synthetic construct
  source 1..20: mol_type = other DNA
ctccagttctcccataatca

SEQ ID NO: 18157 - DNA, 20 bp, synthetic construct
  source 1..20: mol_type = other DNA
tgggagaactggagccttca

SEQ ID NO: 18158 - DNA, 20 bp, synthetic construct
  source 1..20: mol_type = other DNA
tccagttctcccataatcac

SEQ ID NO: 18159 - DNA, 20 bp, synthetic construct
  source 1..20: mol_type = other DNA
gggagaactggagccttcag

SEQ ID NO: 18160 - DNA, 23 bp, synthetic construct
  source 1..23: mol_type = other DNA
tgaaggctccagttctcccataa

SEQ ID NO: 18161 - DNA, 23 bp, synthetic construct
  source 1..23: mol_type = other DNA
tgaaggctccagttctcccataa

SEQ ID NO: 18162 - DNA, 23 bp, synthetic construct
  source 1..23: mol_type = other DNA
tggtgattatgggagaactggag

SEQ ID NO: 18163 - DNA, 21 bp, synthetic construct
  source 1..21: mol_type = other DNA
ggagaactggagccttcagag

SEQ ID NO: 18164 - DNA, 20 bp, synthetic construct
  source 1..20: mol_type = other DNA
ggagaactggagccttcaga

SEQ ID NO: 18165 - DNA, 20 bp, synthetic construct
  source 1..20: mol_type = other DNA
ccagttctcccataatcacc

SEQ ID NO: 18166 - DNA, 20 bp, synthetic construct
  source 1..20: mol_type = other DNA
ggagaactggagccttcaga

SEQ ID NO: 18167 - DNA, 23 bp, synthetic construct
  source 1..23: mol_type = other DNA
ttatgggagaactggagccttca

SEQ ID NO: 18168 - DNA, 21 bp, synthetic construct
  source 1..21: mol_type = other DNA
ggagaactggagccttcagag

SEQ ID NO: 18169 - DNA, 20 bp, synthetic construct
  source 1..20: mol_type = other DNA
ggagaactggagccttcaga

SEQ ID NO: 18170 - DNA, 20 bp, synthetic construct
  source 1..20: mol_type = other DNA
ggagaactggagccttcaga

SEQ ID NO: 18171 - DNA, 20 bp, synthetic construct
  source 1..20: mol_type = other DNA
gagaactggagccttcagag

SEQ ID NO: 18172 - DNA, 20 bp, synthetic construct
  source 1..20: mol_type = other DNA
cagttctcccataatcacca

SEQ ID NO: 18173 - DNA, 20 bp, synthetic construct
  source 1..20: mol_type = other DNA
gagaactggagccttcagag

SEQ ID NO: 18174 - DNA, 23 bp, synthetic construct
  source 1..23: mol_type = other DNA
ttatgggagaactggagccttca

SEQ ID NO: 18175 - DNA, 21 bp, synthetic construct
  source 1..21: mol_type = other DNA
gagaactggagccttcagagg

SEQ ID NO: 18176 - DNA, 21 bp, synthetic construct
  source 1..21: mol_type = other DNA
tgggagaactggagccttcag

SEQ ID NO: 18177 - DNA, 21 bp, synthetic construct
  source 1..21: mol_type = other DNA
tgggagaactggagccttcag

SEQ ID NO: 18178 - DNA, 20 bp, synthetic construct
  source 1..20: mol_type = other DNA
ggagaactggagccttcaga

SEQ ID NO: 18179 - DNA, 20 bp, synthetic construct
  source 1..20: mol_type = other DNA
agttctcccataatcaccat

SEQ ID NO: 18180 - DNA, 20 bp, synthetic construct
  source 1..20: mol_type = other DNA
agaactggagccttcagagg

SEQ ID NO: 18181 - DNA, 20 bp, synthetic construct
  source 1..20: mol_type = other DNA
gggtaaaattaagcacagtg

SEQ ID NO: 18182 - DNA, 21 bp, synthetic construct
  source 1..21: mol_type = other DNA
agttctcccataatcaccatt

SEQ ID NO: 18183 - DNA, 21 bp, synthetic construct
  source 1..21: mol_type = other DNA
agttctcccataatcaccatt

SEQ ID NO: 18184 - DNA, 21 bp, synthetic construct
  source 1..21: mol_type = other DNA
agaactggagccttcagaggg

SEQ ID NO: 18185 - DNA, 21 bp, synthetic construct
  source 1..21: mol_type = other DNA
tgggagaactggagccttcag

SEQ ID NO: 18186 - DNA, 20 bp, synthetic construct
  source 1..20: mol_type = other DNA
gttctcccataatcaccatt

SEQ ID NO: 18187 - DNA, 20 bp, synthetic construct
  source 1..20: mol_type = other DNA
gaactggagccttcagaggg

SEQ ID NO: 18188 - DNA, 20 bp, synthetic construct
  source 1..20: mol_type = other DNA
gggtaaaattaagcacagtg

SEQ ID NO: 18189 - DNA, 21 bp, synthetic construct
  source 1..21: mol_type = other DNA
agttctcccataatcaccatt

SEQ ID NO: 18190 - DNA, 21 bp, synthetic construct
  source 1..21: mol_type = other DNA
agaactggagccttcagaggg

SEQ ID NO: 18191 - DNA, 20 bp, synthetic construct
  source 1..20: mol_type = other DNA
gttctcccataatcaccatt

SEQ ID NO: 18192 - DNA, 20 bp, synthetic construct
  source 1..20: mol_type = other DNA
ttctcccataatcaccatta

SEQ ID NO: 18193 - DNA, 20 bp, synthetic construct
  source 1..20: mol_type = other DNA
aactggagccttcagagggt

SEQ ID NO: 18194 - DNA, 23 bp, synthetic construct
  source 1..23: mol_type = other DNA
ttctcccataatcaccattagaa

SEQ ID NO: 18195 - DNA, 21 bp, synthetic construct
  source 1..21: mol_type = other DNA
tctcccataatcaccattaga

SEQ ID NO: 18196 - DNA, 20 bp, synthetic construct
  source 1..20: mol_type = other DNA
tctcccataatcaccattag

SEQ ID NO: 18197 - DNA, 20 bp, synthetic construct
  source 1..20: mol_type = other DNA
tctcccataatcaccattag

SEQ ID NO: 18198 - DNA, 20 bp, synthetic construct
  source 1..20: mol_type = other DNA
actggagccttcagagggta

SEQ ID NO: 18199 - DNA, 21 bp, synthetic construct
  source 1..21: mol_type = other DNA
tctcccataatcaccattaga

SEQ ID NO: 18200 - DNA, 21 bp, synthetic construct
  source 1..21: mol_type = other DNA
gttctcccataatcaccatta

SEQ ID NO: 18201 - DNA, 20 bp, synthetic construct
  source 1..20: mol_type = other DNA
ctcccataatcaccattaga

SEQ ID NO: 18202 - DNA, 20 bp, synthetic construct
  source 1..20: mol_type = other DNA
ctggagccttcagagggtaa

SEQ ID NO: 18203 - DNA, 20 bp, synthetic construct
  source 1..20: mol_type = other DNA
atcaccattagaagtgaagt

SEQ ID NO: 18204 - DNA, 21 bp, synthetic construct
  source 1..21: mol_type = other DNA
ctcccataatcaccattagaa

SEQ ID NO: 18205 - DNA, 20 bp, synthetic construct
  source 1..20: mol_type = other DNA
tcccataatcaccattagaa

SEQ ID NO: 18206 - DNA, 20 bp, synthetic construct
  source 1..20: mol_type = other DNA
tggagccttcagagggtaaa

SEQ ID NO: 18207 - DNA, 21 bp, synthetic construct
  source 1..21: mol_type = other DNA
tcccataatcaccattagaag

SEQ ID NO: 18208 - DNA, 20 bp, synthetic construct
  source 1..20: mol_type = other DNA
cccataatcaccattagaag

SEQ ID NO: 18209 - DNA, 20 bp, synthetic construct
  source 1..20: mol_type = other DNA
ggagccttcagagggtaaaa

SEQ ID NO: 18210 - DNA, 23 bp, synthetic construct
  source 1..23: mol_type = other DNA
ctggagccttcagagggtaaaat

SEQ ID NO: 18211 - DNA, 23 bp, synthetic construct
  source 1..23: mol_type = other DNA
ctggagccttcagagggtaaaat

SEQ ID NO: 18212 - DNA, 21 bp, synthetic construct
  source 1..21: mol_type = other DNA
tcccataatcaccattagaag

SEQ ID NO: 18213 - DNA, 20 bp, synthetic construct
  source 1..20: mol_type = other DNA
ccataatcaccattagaagt

SEQ ID NO: 18214 - DNA, 20 bp, synthetic construct
  source 1..20: mol_type = other DNA
gagccttcagagggtaaaat

SEQ ID NO: 18215 - DNA, 20 bp, synthetic construct
  source 1..20: mol_type = other DNA
cataatcaccattagaagtg

SEQ ID NO: 18216 - DNA, 20 bp, synthetic construct
  source 1..20: mol_type = other DNA
agccttcagagggtaaaatt

SEQ ID NO: 18217 - DNA, 20 bp, synthetic construct
  source 1..20: mol_type = other DNA
ataatcaccattagaagtga

SEQ ID NO: 18218 - DNA, 20 bp, synthetic construct
  source 1..20: mol_type = other DNA
gccttcagagggtaaaatta

SEQ ID NO: 18219 - DNA, 23 bp, synthetic construct
  source 1..23: mol_type = other DNA
ggagccttcagagggtaaaatta

SEQ ID NO: 18220 - DNA, 20 bp, synthetic construct
  source 1..20: mol_type = other DNA
taatcaccattagaagtgaa

SEQ ID NO: 18221 - DNA, 20 bp, synthetic construct
  source 1..20: mol_type = other DNA
ccttcagagggtaaaattaa

SEQ ID NO: 18222 - DNA, 24 bp, synthetic construct
  source 1..24: mol_type = other DNA
gaagtgaagtctggaaataaaacc

SEQ ID NO: 18223 - DNA, 20 bp, synthetic construct
  source 1..20: mol_type = other DNA
aatcaccattagaagtgaag

SEQ ID NO: 18224 - DNA, 20 bp, synthetic construct
  source 1..20: mol_type = other DNA
cttcagagggtaaaattaag

SEQ ID NO: 18225 - DNA, 24 bp, synthetic construct
  source 1..24: mol_type = other DNA
agagggtaaaattaagcacagtgg

SEQ ID NO: 18226 - DNA, 20 bp, synthetic construct
  source 1..20: mol_type = other DNA
atcaccattagaagtgaagt

SEQ ID NO: 18227 - DNA, 20 bp, synthetic construct
  source 1..20: mol_type = other DNA
ttcagagggtaaaattaagc

SEQ ID NO: 18228 - DNA, 23 bp, synthetic construct
  source 1..23: mol_type = other DNA
tcccataatcaccattagaagtg

SEQ ID NO: 18229 - DNA, 23 bp, synthetic construct
  source 1..23: mol_type = other DNA
tcccataatcaccattagaagtg

SEQ ID NO: 18230 - DNA, 24 bp, synthetic construct
  source 1..24: mol_type = other DNA
ccattagaagtgaagtctggaaat

SEQ ID NO: 18231 - DNA, 20 bp, synthetic construct
  source 1..20: mol_type = other DNA
tcaccattagaagtgaagtc

SEQ ID NO: 18232 - DNA, 20 bp, synthetic construct
  source 1..20: mol_type = other DNA
tcaccattagaagtgaagtc

SEQ ID NO: 18233 - DNA, 20 bp, synthetic construct
  source 1..20: mol_type = other DNA
tcagagggtaaaattaagca

SEQ ID NO: 18234 - DNA, 23 bp, synthetic construct
  source 1..23: mol_type = other DNA
tcccataatcaccattagaagtg

SEQ ID NO: 18235 - DNA, 23 bp, synthetic construct
  source 1..23: mol_type = other DNA
tcccataatcaccattagaagtg

SEQ ID NO: 18236 - DNA, 20 bp, synthetic construct
  source 1..20: mol_type = other DNA
tcaccattagaagtgaagtc

SEQ ID NO: 18237 - DNA, 20 bp, synthetic construct
  source 1..20: mol_type = other DNA
tcaccattagaagtgaagtc

SEQ ID NO: 18238 - DNA, 20 bp, synthetic construct
  source 1..20: mol_type = other DNA
caccattagaagtgaagtct

SEQ ID NO: 18239 - DNA, 20 bp, synthetic construct
  source 1..20: mol_type = other DNA
caccattagaagtgaagtct

SEQ ID NO: 18240 - DNA, 20 bp, synthetic construct
  source 1..20: mol_type = other DNA
cagagggtaaaattaagcac

SEQ ID NO: 18241 - DNA, 21 bp, synthetic construct
  source 1..21: mol_type = other DNA
aatcaccattagaagtgaagt

SEQ ID NO: 18242 - DNA, 21 bp, synthetic construct
  source 1..21: mol_type = other DNA
aatcaccattagaagtgaagt

SEQ ID NO: 18243 - DNA, 20 bp, synthetic construct
  source 1..20: mol_type = other DNA
tcaccattagaagtgaagtc

SEQ ID NO: 18244 - DNA, 20 bp, synthetic construct
  source 1..20: mol_type = other DNA
accattagaagtgaagtctg

SEQ ID NO: 18245 - DNA, 20 bp, synthetic construct
  source 1..20: mol_type = other DNA
agagggtaaaattaagcaca

SEQ ID NO: 18246 - DNA, 23 bp, synthetic construct
  source 1..23: mol_type = other DNA
cattagaagtgaagtctggaaat

SEQ ID NO: 18247 - DNA, 21 bp, synthetic construct
  source 1..21: mol_type = other DNA
ccattagaagtgaagtctgga

SEQ ID NO: 18248 - DNA, 20 bp, synthetic construct
  source 1..20: mol_type = other DNA
ccattagaagtgaagtctgg

SEQ ID NO: 18249 - DNA, 20 bp, synthetic construct
  source 1..20: mol_type = other DNA
gagggtaaaattaagcacag

SEQ ID NO: 18250 - DNA, 23 bp, synthetic construct
  source 1..23: mol_type = other DNA
ggagccttcagagggtaaaatta

SEQ ID NO: 18251 - DNA, 23 bp, synthetic construct
  source 1..23: mol_type = other DNA
ggagccttcagagggtaaaatta

SEQ ID NO: 18252 - DNA, 20 bp, synthetic construct
  source 1..20: mol_type = other DNA
agggtaaaattaagcacagt

SEQ ID NO: 18253 - DNA, 20 bp, synthetic construct
  source 1..20: mol_type = other DNA
cattagaagtgaagtctgga

SEQ ID NO: 18254 - DNA, 20 bp, synthetic construct
  source 1..20: mol_type = other DNA
agggtaaaattaagcacagt

SEQ ID NO: 18255-18392 - skipped (138 entries)

SEQ ID NO: 18393 - DNA, 20 bp, synthetic construct
  source 1..20: mol_type = other DNA
gggtagtgtgaagggttcat

SEQ ID NO: 18394 - DNA, 20 bp, synthetic construct
  source 1..20: mol_type = other DNA
aaaactttttgattatgcat

SEQ ID NO: 18395 - DNA, 20 bp, synthetic construct
  source 1..20: mol_type = other DNA
gggtagtgtgaagggttcat

SEQ ID NO: 18396 - DNA, 20 bp, synthetic construct
  source 1..20: mol_type = other DNA
gattatgcatatgaaccctt

SEQ ID NO: 18397 - DNA, 21 bp, synthetic construct
  source 1..21: mol_type = other DNA
gcatatgaacccttcacacta

SEQ ID NO: 18398 - DNA, 21 bp, synthetic construct
  source 1..21: mol_type = other DNA
gcatatgaacccttcacacta

SEQ ID NO: 18399 - DNA, 20 bp, synthetic construct
  source 1..20: mol_type = other DNA
ggtagtgtgaagggttcata

SEQ ID NO: 18400 - DNA, 20 bp, synthetic construct
  source 1..20: mol_type = other DNA
ggtagtgtgaagggttcata

SEQ ID NO: 18401 - DNA, 20 bp, synthetic construct
  source 1..20: mol_type = other DNA
attatgcatatgaacccttc

SEQ ID NO: 18402 - DNA, 24 bp, synthetic construct
  source 1..24: mol_type = other DNA
gtgaagggttcatatgcataatca

SEQ ID NO: 18403 - DNA, 20 bp, synthetic construct
  source 1..20: mol_type = other DNA
gggtagtgtgaagggttcat

SEQ ID NO: 18404 - DNA, 20 bp, synthetic construct
  source 1..20: mol_type = other DNA
tataatttgggtagtgtgaa

SEQ ID NO: 18405 - DNA, 20 bp, synthetic construct
  source 1..20: mol_type = other DNA
ggtagtgtgaagggttcata

SEQ ID NO: 18406 - DNA, 20 bp, synthetic construct
  source 1..20: mol_type = other DNA
gtagtgtgaagggttcatat

SEQ ID NO: 18407 - DNA, 20 bp, synthetic construct
  source 1..20: mol_type = other DNA
ttatgcatatgaacccttca

SEQ ID NO: 18408 - DNA, 21 bp, synthetic construct
  source 1..21: mol_type = other DNA
tatataatttgggtagtgtga

SEQ ID NO: 18409 - DNA, 21 bp, synthetic construct
  source 1..21: mol_type = other DNA
agggttcatatgcataatcaa

SEQ ID NO: 18410 - DNA, 20 bp, synthetic construct
  source 1..20: mol_type = other DNA
gggtagtgtgaagggttcat

SEQ ID NO: 18411 - DNA, 20 bp, synthetic construct
  source 1..20: mol_type = other DNA
tagtgtgaagggttcatatg

SEQ ID NO: 18412 - DNA, 20 bp, synthetic construct
  source 1..20: mol_type = other DNA
tatgcatatgaacccttcac

SEQ ID NO: 18413 - DNA, 21 bp, synthetic construct
  source 1..21: mol_type = other DNA
gtagtgtgaagggttcatatg

SEQ ID NO: 18414 - DNA, 21 bp, synthetic construct
  source 1..21: mol_type = other DNA
gtagtgtgaagggttcatatg

SEQ ID NO: 18415 - DNA, 21 bp, synthetic construct
  source 1..21: mol_type = other DNA
gcatatgaacccttcacacta

SEQ ID NO: 18416 - DNA, 21 bp, synthetic construct
  source 1..21: mol_type = other DNA
gcatatgaacccttcacacta

SEQ ID NO: 18417 - DNA, 20 bp, synthetic construct
  source 1..20: mol_type = other DNA
agtgtgaagggttcatatgc

SEQ ID NO: 18418 - DNA, 20 bp, synthetic construct
  source 1..20: mol_type = other DNA
atgcatatgaacccttcaca

SEQ ID NO: 18419 - DNA, 20 bp, synthetic construct
  source 1..20: mol_type = other DNA
gtgtgaagggttcatatgca

SEQ ID NO: 18420 - DNA, 20 bp, synthetic construct
  source 1..20: mol_type = other DNA
tgcatatgaacccttcacac

SEQ ID NO: 18421 - DNA, 20 bp, synthetic construct
  source 1..20: mol_type = other DNA
tgtgaagggttcatatgcat

SEQ ID NO: 18422 - DNA, 20 bp, synthetic construct
  source 1..20: mol_type = other DNA
gcatatgaacccttcacact

SEQ ID NO: 18423 - DNA, 23 bp, synthetic construct
  source 1..23: mol_type = other DNA
ttatgcatatgaacccttcacac

SEQ ID NO: 18424 - DNA, 23 bp, synthetic construct
  source 1..23: mol_type = other DNA
ttatgcatatgaacccttcacac

SEQ ID NO: 18425 - DNA, 24 bp, synthetic construct
  source 1..24: mol_type = other DNA
gattatgcatatgaacccttcaca

SEQ ID NO: 18426 - DNA, 20 bp, synthetic construct
  source 1..20: mol_type = other DNA
gtgaagggttcatatgcata

SEQ ID NO: 18427 - DNA, 20 bp, synthetic construct
  source 1..20: mol_type = other DNA
catatgaacccttcacacta

SEQ ID NO: 18428 - DNA, 23 bp, synthetic construct
  source 1..23: mol_type = other DNA
ttatgcatatgaacccttcacac

SEQ ID NO: 18429 - DNA, 23 bp, synthetic construct
  source 1..23: mol_type = other DNA
ttatgcatatgaacccttcacac

SEQ ID NO: 18430 - DNA, 23 bp, synthetic construct
  source 1..23: mol_type = other DNA
ttatgcatatgaacccttcacac

SEQ ID NO: 18431 - DNA, 24 bp, synthetic construct
  source 1..24: mol_type = other DNA
gtgaagggttcatatgcataatca

SEQ ID NO: 18432 - DNA, 20 bp, synthetic construct
  source 1..20: mol_type = other DNA
tgaagggttcatatgcataa

SEQ ID NO: 18433 - DNA, 20 bp, synthetic construct
  source 1..20: mol_type = other DNA
atatgaacccttcacactac

SEQ ID NO: 18434 - DNA, 20 bp, synthetic construct
  source 1..20: mol_type = other DNA
gaagggttcatatgcataat

SEQ ID NO: 18435 - DNA, 20 bp, synthetic construct
  source 1..20: mol_type = other DNA
tatgaacccttcacactacc

SEQ ID NO: 18436 - DNA, 23 bp, synthetic construct
  source 1..23: mol_type = other DNA
gtagtgtgaagggttcatatgca

SEQ ID NO: 18437 - DNA, 23 bp, synthetic construct
  source 1..23: mol_type = other DNA
gtagtgtgaagggttcatatgca

SEQ ID NO: 18438 - DNA, 23 bp, synthetic construct
  source 1..23: mol_type = other DNA
ttatgcatatgaacccttcacac

SEQ ID NO: 18439 - DNA, 21 bp, synthetic construct
  source 1..21: mol_type = other DNA
catatgaacccttcacactac

SEQ ID NO: 18440 - DNA, 20 bp, synthetic construct
  source 1..20: mol_type = other DNA
cactacccaaattatatatt

SEQ ID NO: 18441 - DNA, 20 bp, synthetic construct
  source 1..20: mol_type = other DNA
aagggttcatatgcataatc

SEQ ID NO: 18442 - DNA, 20 bp, synthetic construct
  source 1..20: mol_type = other DNA
atgaacccttcacactaccc

SEQ ID NO: 18443 - DNA, 23 bp, synthetic construct
  source 1..23: mol_type = other DNA
gtgaaaactttttgattatgcat

SEQ ID NO: 18444 - DNA, 21 bp, synthetic construct
  source 1..21: mol_type = other DNA
catatgaacccttcacactac

SEQ ID NO: 18445 - DNA, 20 bp, synthetic construct
  source 1..20: mol_type = other DNA
acactacccaaattatatat

SEQ ID NO: 18446 - DNA, 20 bp, synthetic construct
  source 1..20: mol_type = other DNA
cactacccaaattatatatt

SEQ ID NO: 18447 - DNA, 20 bp, synthetic construct
  source 1..20: mol_type = other DNA
cactacccaaattatatatt

SEQ ID NO: 18448 - DNA, 20 bp, synthetic construct
  source 1..20: mol_type = other DNA
agggttcatatgcataatca

SEQ ID NO: 18449 - DNA, 20 bp, synthetic construct
  source 1..20: mol_type = other DNA
tgaacccttcacactaccca

SEQ ID NO: 18450 - DNA, 23 bp, synthetic construct
  source 1..23: mol_type = other DNA
gtgaaaactttttgattatgcat

SEQ ID NO: 18451 - DNA, 21 bp, synthetic construct
  source 1..21: mol_type = other DNA
catatgaacccttcacactac

SEQ ID NO: 18452 - DNA, 21 bp, synthetic construct
  source 1..21: mol_type = other DNA
cacactacccaaattatatat

SEQ ID NO: 18453 - DNA, 21 bp, synthetic construct
  source 1..21: mol_type = other DNA
cacactacccaaattatatat

SEQ ID NO: 18454 - DNA, 20 bp, synthetic construct
  source 1..20: mol_type = other DNA
acactacccaaattatatat

SEQ ID NO: 18455 - DNA, 20 bp, synthetic construct
  source 1..20: mol_type = other DNA
gggttcatatgcataatcaa

SEQ ID NO: 18456 - DNA, 20 bp, synthetic construct
  source 1..20: mol_type = other DNA
gaacccttcacactacccaa

SEQ ID NO: 18457 - DNA, 20 bp, synthetic construct
  source 1..20: mol_type = other DNA
agcatgccaactagaagagg

SEQ ID NO: 18458 - DNA, 21 bp, synthetic construct
  source 1..21: mol_type = other DNA
aagggttcatatgcataatca

SEQ ID NO: 18459 - DNA, 21 bp, synthetic construct
  source 1..21: mol_type = other DNA
aagggttcatatgcataatca

SEQ ID NO: 18460 - DNA, 21 bp, synthetic construct
  source 1..21: mol_type = other DNA
catatgaacccttcacactac

SEQ ID NO: 18461 - DNA, 21 bp, synthetic construct
  source 1..21: mol_type = other DNA
cacactacccaaattatatat

SEQ ID NO: 18462 - DNA, 20 bp, synthetic construct
  source 1..20: mol_type = other DNA
ggttcatatgcataatcaaa

SEQ ID NO: 18463 - DNA, 20 bp, synthetic construct
  source 1..20: mol_type = other DNA
aacccttcacactacccaaa

SEQ ID NO: 18464 - DNA, 20 bp, synthetic construct
  source 1..20: mol_type = other DNA
agcatgccaactagaagagg

SEQ ID NO: 18465 - DNA, 21 bp, synthetic construct
  source 1..21: mol_type = other DNA
aagggttcatatgcataatca

SEQ ID NO: 18466 - DNA, 21 bp, synthetic construct
  source 1..21: mol_type = other DNA
catatgaacccttcacactac

SEQ ID NO: 18467 - DNA, 20 bp, synthetic construct
  source 1..20: mol_type = other DNA
gttcatatgcataatcaaaa

SEQ ID NO: 18468 - DNA, 20 bp, synthetic construct
  source 1..20: mol_type = other DNA
gttcatatgcataatcaaaa

SEQ ID NO: 18469 - DNA, 20 bp, synthetic construct
  source 1..20: mol_type = other DNA
acccttcacactacccaaat

SEQ ID NO: 18470 - DNA, 23 bp, synthetic construct
  source 1..23: mol_type = other DNA
aaatatataatttgggtagtgtg

SEQ ID NO: 18471 - DNA, 21 bp, synthetic construct
  source 1..21: mol_type = other DNA
aagggttcatatgcataatca

SEQ ID NO: 18472 - DNA, 20 bp, synthetic construct
  source 1..20: mol_type = other DNA
ggttcatatgcataatcaaa

SEQ ID NO: 18473 - DNA, 20 bp, synthetic construct
  source 1..20: mol_type = other DNA
ttcatatgcataatcaaaaa

SEQ ID NO: 18474 - DNA, 20 bp, synthetic construct
  source 1..20: mol_type = other DNA
cccttcacactacccaaatt

SEQ ID NO: 18475 - DNA, 21 bp, synthetic construct
  source 1..21: mol_type = other DNA
aagggttcatatgcataatca

SEQ ID NO: 18476 - DNA, 21 bp, synthetic construct
  source 1..21: mol_type = other DNA
agggttcatatgcataatcaa

SEQ ID NO: 18477 - DNA, 20 bp, synthetic construct
  source 1..20: mol_type = other DNA
tcatatgcataatcaaaaag

SEQ ID NO: 18478 - DNA, 20 bp, synthetic construct
  source 1..20: mol_type = other DNA
ccttcacactacccaaatta

SEQ ID NO: 18479 - skipped

SEQ ID NO: 18480 - DNA, 21 bp, synthetic construct
  source 1..21: mol_type = other DNA
tgcataatcaaaaagttttca

SEQ ID NO: 18481 - DNA, 20 bp, synthetic construct
  source 1..20: mol_type = other DNA
catatgcataatcaaaaagt

SEQ ID NO: 18482 - DNA, 20 bp, synthetic construct
  source 1..20: mol_type = other DNA
cttcacactacccaaattat

SEQ ID NO: 18483 - DNA, 21 bp, synthetic construct
  source 1..21: mol_type = other DNA
tgcataatcaaaaagttttca

SEQ ID NO: 18484 - DNA, 20 bp, synthetic construct
  source 1..20: mol_type = other DNA
atatgcataatcaaaaagtt

SEQ ID NO: 18485 - DNA, 20 bp, synthetic construct
  source 1..20: mol_type = other DNA
ttcacactacccaaattata

SEQ ID NO: 18486 - DNA, 23 bp, synthetic construct
  source 1..23: mol_type = other DNA
ttcacactacccaaattatatat

SEQ ID NO: 18487 - DNA, 23 bp, synthetic construct
  source 1..23: mol_type = other DNA
ttcacactacccaaattatatat

SEQ ID NO: 18488 - DNA, 21 bp, synthetic construct
  source 1..21: mol_type = other DNA
tgcataatcaaaaagttttca

SEQ ID NO: 18489 - DNA, 20 bp, synthetic construct
  source 1..20: mol_type = other DNA
tatgcataatcaaaaagttt

SEQ ID NO: 18490 - DNA, 20 bp, synthetic construct
  source 1..20: mol_type = other DNA
tcacactacccaaattatat

SEQ ID NO: 18491 - DNA, 20 bp, synthetic construct
  source 1..20: mol_type = other DNA
atgcataatcaaaaagtttt

SEQ ID NO: 18492 - DNA, 20 bp, synthetic construct
  source 1..20: mol_type = other DNA
cacactacccaaattatata

SEQ ID NO: 18493 - DNA, 20 bp, synthetic construct
  source 1..20: mol_type = other DNA
tgcataatcaaaaagttttc

SEQ ID NO: 18494 - DNA, 20 bp, synthetic construct
  source 1..20: mol_type = other DNA
acactacccaaattatatat

SEQ ID NO: 18495 - DNA, 23 bp, synthetic construct
  source 1..23: mol_type = other DNA
ttcacactacccaaattatatat

SEQ ID NO: 18496 - DNA, 20 bp, synthetic construct
  source 1..20: mol_type = other DNA
gcataatcaaaaagttttca

SEQ ID NO: 18497 - DNA, 20 bp, synthetic construct
  source 1..20: mol_type = other DNA
cactacccaaattatatatt

SEQ ID NO: 18498 - DNA, 24 bp, synthetic construct
  source 1..24: mol_type = other DNA
atatgcataatcaaaaagttttca

SEQ ID NO: 18499 - DNA, 20 bp, synthetic construct
  source 1..20: mol_type = other DNA
cataatcaaaaagttttcac

SEQ ID NO: 18500 - DNA, 20 bp, synthetic construct
  source 1..20: mol_type = other DNA
actacccaaattatatattt

SEQ ID NO: 18501 - DNA, 24 bp, synthetic construct
  source 1..24: mol_type = other DNA
actacccaaattatatatttggct

SEQ ID NO: 18502 - DNA, 20 bp, synthetic construct
  source 1..20: mol_type = other DNA
ataatcaaaaagttttcaca

SEQ ID NO: 18503 - DNA, 20 bp, synthetic construct
  source 1..20: mol_type = other DNA
ctacccaaattatatatttg

SEQ ID NO: 18504 - DNA, 23 bp, synthetic construct
  source 1..23: mol_type = other DNA
cataatcaaaaagttttcacata

SEQ ID NO: 18505 - DNA, 23 bp, synthetic construct
  source 1..23: mol_type = other DNA
cataatcaaaaagttttcacata

SEQ ID NO: 18506 - DNA, 24 bp, synthetic construct
  source 1..24: mol_type = other DNA
aatcaaaaagttttcacatagttt

SEQ ID NO: 18507 - DNA, 20 bp, synthetic construct
  source 1..20: mol_type = other DNA
taatcaaaaagttttcacat

SEQ ID NO: 18508 - DNA, 20 bp, synthetic construct
  source 1..20: mol_type = other DNA
taatcaaaaagttttcacat

SEQ ID NO: 18509 - DNA, 20 bp, synthetic construct
  source 1..20: mol_type = other DNA
tacccaaattatatatttgg

SEQ ID NO: 18510 - DNA, 23 bp, synthetic construct
  source 1..23: mol_type = other DNA
cataatcaaaaagttttcacata

SEQ ID NO: 18511 - DNA, 23 bp, synthetic construct
  source 1..23: mol_type = other DNA
cataatcaaaaagttttcacata

SEQ ID NO: 18512 - DNA, 20 bp, synthetic construct
  source 1..20: mol_type = other DNA
ataatcaaaaagttttcaca

SEQ ID NO: 18513 - DNA, 20 bp, synthetic construct
  source 1..20: mol_type = other DNA
agtttcttacctcttctagt

SEQ ID NO: 18514 - DNA, 20 bp, synthetic construct
  source 1..20: mol_type = other DNA
taatcaaaaagttttcacat

SEQ ID NO: 18515 - DNA, 20 bp, synthetic construct
  source 1..20: mol_type = other DNA
aatcaaaaagttttcacata

SEQ ID NO: 18516 - DNA, 20 bp, synthetic construct
  source 1..20: mol_type = other DNA
acccaaattatatatttggc

SEQ ID NO: 18517 - DNA, 21 bp, synthetic construct
  source 1..21: mol_type = other DNA
atagtttcttacctcttctag

SEQ ID NO: 18518 - DNA, 21 bp, synthetic construct
  source 1..21: mol_type = other DNA
gcataatcaaaaagttttcac

SEQ ID NO: 18519 - DNA, 20 bp, synthetic construct
  source 1..20: mol_type = other DNA
ataatcaaaaagttttcaca

SEQ ID NO: 18520 - DNA, 20 bp, synthetic construct
  source 1..20: mol_type = other DNA
atcaaaaagttttcacatag

SEQ ID NO: 18521 - DNA, 20 bp, synthetic construct
  source 1..20: mol_type = other DNA
cccaaattatatatttggct

SEQ ID NO: 18522 - DNA, 23 bp, synthetic construct
  source 1..23: mol_type = other DNA
cataatcaaaaagttttcacata

SEQ ID NO: 18523 - DNA, 21 bp, synthetic construct
  source 1..21: mol_type = other DNA
tgcataatcaaaaagttttca

SEQ ID NO: 18524 - DNA, 20 bp, synthetic construct
  source 1..20: mol_type = other DNA
tcaaaaagttttcacatagt

SEQ ID NO: 18525 - DNA, 20 bp, synthetic construct
  source 1..20: mol_type = other DNA
ccaaattatatatttggctc

SEQ ID NO: 18526 - DNA, 23 bp, synthetic construct
  source 1..23: mol_type = other DNA
cccaaattatatatttggctcca

SEQ ID NO: 18527 - DNA, 23 bp, synthetic construct
  source 1..23: mol_type = other DNA
cccaaattatatatttggctcca

SEQ ID NO: 18528 - DNA, 20 bp, synthetic construct
  source 1..20: mol_type = other DNA
actacccaaattatatattt

SEQ ID NO: 18529 - DNA, 20 bp, synthetic construct
  source 1..20: mol_type = other DNA
caaaaagttttcacatagtt

SEQ ID NO: 18530 - DNA, 20 bp, synthetic construct
  source 1..20: mol_type = other DNA
caaattatatatttggctcc

SEQ ID NO: 18531-18668 - skipped (138 entries)

SEQ ID NO: 18669 - DNA, 138 bp, synthetic construct
  source 1..138: mol_type = other DNA
cattaaagaaaatatcattggttttagagctagaaatagcaagttaaaataaggctagtccgttatcaacttgaaaaagtggcaccgagtcggtgcatctatattcatcataggaaacaccaaagatgatattttctt

SEQ ID NO: 18670 - DNA, 138 bp, synthetic construct
  source 1..138: mol_type = other DNA
attcatcataggaaacaccagttttagagctagaaatagcaagttaaaataaggctagtccgttatcaacttgaaaaagtggcaccgagtcggtgctggcaccattaaagaaaatatcatctttggtgtttcctatga

SEQ ID NO: 18671 - DNA, 138 bp, synthetic construct; identical to SEQ ID NO: 18669
  source 1..138: mol_type = other DNA

SEQ ID NO: 18672 - DNA, 138 bp, synthetic construct; identical to SEQ ID NO: 18670
  source 1..138: mol_type = other DNA

SEQ ID NO: 18673 - DNA, 139 bp, synthetic construct
  source 1..139: mol_type = other DNA
atattcatcataggaaacaccgttttagtactctggaaacagaatctactaaaacaaggcaaaatgccgtgtttatctcgtcaacttgttggcgagaggcaccattaaagaaaatatcatctttggtgtttcctatgat

SEQ ID NO: 18674 - DNA, 139 bp, synthetic construct; identical to SEQ ID NO: 18673
  source 1..139: mol_type = other DNA

SEQ ID NO: 18675 - DNA, 138 bp, synthetic construct
  source 1..138: mol_type = other DNA
ccattaaagaaaatatcattgttttagagctagaaatagcaagttaaaataaggctagtccgttatcaacttgaaaaagtggcaccgagtcggtgctctatattcatcataggaaacaccaaagatgatattttcttt

SEQ ID NO: 18676 - DNA, 138 bp, synthetic construct; identical to SEQ ID NO: 18675
  source 1..138: mol_type = other DNA

SEQ ID NO: 18677 - DNA, 138 bp, synthetic construct
  source 1..138: mol_type = other DNA
tattcatcataggaaacaccgttttagagctagaaatagcaagttaaaataaggctagtccgttatcaacttgaaaaagtggcaccgagtcggtgcggcaccattaaagaaaatatcatctttggtgtttcctatgat

SEQ ID NO: 18678 - DNA, 177 bp, synthetic construct
  source 1..177: mol_type = other DNA
tggcaccattaaagaaaatatcatgttgtagctccctttttcatttcgcgaaagcgaaatgaaaaacgttgttacaataagagatgaatttctcgcaaagctctgcctcttgaaatttcggtttcaagaggcatcctatattcatcataggaaacaccaaagatgatattttcttta

SEQ ID NO: 18679 - DNA, 138 bp, synthetic construct
  source 1..138: mol_type = other DNA
accattaaagaaaatatcatgttttagagctagaaatagcaagttaaaataaggctagtccgttatcaacttgaaaaagtggcaccgagtcggtgcctatattcatcataggaaacaccaaagatgatattttcttta

SEQ ID NO: 18680 - DNA, 138 bp, synthetic construct; identical to SEQ ID NO: 18679
  source 1..138: mol_type = other DNA

SEQ ID NO: 18681 - DNA, 138 bp, synthetic construct; identical to SEQ ID NO: 18679
  source 1..138: mol_type = other DNA

SEQ ID NO: 18682 - DNA, 138 bp, synthetic construct; identical to SEQ ID NO: 18679
  source 1..138: mol_type = other DNA

SEQ ID NO: 18683 - DNA, 138 bp, synthetic construct
  source 1..138: mol_type = other DNA
atattcatcataggaaacacgttttagagctagaaatagcaagttaaaataaggctagtccgttatcaacttgaaaaagtggcaccgagtcggtgcgcaccattaaagaaaatatcatctttggtgtttcctatgatg

SEQ ID NO: 18684 - DNA, 139 bp, synthetic construct
  source 1..139: mol_type = other DNA
gcaccattaaagaaaatatcagttttagtactctggaaacagaatctactaaaacaaggcaaaatgccgtgtttatctcgtcaacttgttggcgagatatattcatcataggaaacaccaaagatgatattttctttaa

SEQ ID NO: 18685 - DNA, 139 bp, synthetic construct; identical to SEQ ID NO: 18684
  source 1..139: mol_type = other DNA

SEQ ID NO: 18686 - DNA, 138 bp, synthetic construct
  source 1..138: mol_type = other DNA
caccattaaagaaaatatcagttttagagctagaaatagcaagttaaaataaggctagtccgttatcaacttgaaaaagtggcaccgagtcggtgctatattcatcataggaaacaccaaagatgatattttctttaa

SEQ ID NO: 18687 - DNA, 138 bp, synthetic construct; identical to SEQ ID NO: 18686
  source 1..138: mol_type = other DNA

SEQ ID NO: 18688 - DNA, 138 bp, synthetic construct
  source 1..138: mol_type = other DNA
tatattcatcataggaaacagttttagagctagaaatagcaagttaaaataaggctagtccgttatcaacttgaaaaagtggcaccgagtcggtgccaccattaaagaaaatatcatctttggtgtttcctatgatga

SEQ ID NO: 18689 - DNA, 139 bp, synthetic construct
  source 1..139: mol_type = other DNA
ggcaccattaaagaaaatatcgttttagtactctggaaacagaatctactaaaacaaggcaaaatgccgtgtttatctcgtcaacttgttggcgagaatattcatcataggaaacaccaaagatgatattttctttaat

SEQ ID NO: 18690 - DNA, 139 bp, synthetic construct; identical to SEQ ID NO: 18689
  source 1..139: mol_type = other DNA

SEQ ID NO: 18691 - DNA, 139 bp, synthetic construct
  source 1..139: mol_type = other DNA
tctatattcatcataggaaacgttttagtactctggaaacagaatctactaaaacaaggcaaaatgccgtgtttatctcgtcaacttgttggcgagaaccattaaagaaaatatcatctttggtgtttcctatgatgaa

SEQ ID NO: 18692 - DNA, 139 bp, synthetic construct; identical to SEQ ID NO: 18691
  source 1..139: mol_type = other DNA

SEQ ID NO: 18693 - DNA, 138 bp, synthetic construct
  source 1..138: mol_type = other DNA
gcaccattaaagaaaatatcgttttagagctagaaatagcaagttaaaataaggctagtccgttatcaacttgaaaaagtggcaccgagtcggtgcatattcatcataggaaacaccaaagatgatattttctttaat

SEQ ID NO: 18694 - DNA, 138 bp, synthetic construct
  source 1..138: mol_type = other DNA
ctatattcatcataggaaacgttttagagctagaaatagcaagttaaaataaggctagtccgttatcaacttgaaaaagtggcaccgagtcggtgcaccattaaagaaaatatcatctttggtgtttcctatgatgaa

SEQ ID NO: 18695 - DNA, 138 bp, synthetic construct
  source 1..138: mol_type = other DNA
ggcaccattaaagaaaatatgttttagagctagaaatagcaagttaaaataaggctagtccgttatcaacttgaaaaagtggcaccgagtcggtgctattcatcataggaaacaccaaagatgatattttctttaatg

SEQ ID NO: 18696 - DNA, 138 bp, synthetic construct
  source 1..138: mol_type = other DNA
tctatattcatcataggaaagttttagagctagaaatagcaagttaaaataaggctagtccgttatcaacttgaaaaagtggcaccgagtcggtgcccattaaagaaaatatcatctttggtgtttcctatgatgaat

SEQ ID NO: 18697 - DNA, 138 bp, synthetic construct
  source 1..138: mol_type = other DNA
tggcaccattaaagaaaatagttttagagctagaaatagcaagttaaaataaggctagtccgttatcaacttgaaaaagtggcaccgagtcggtgcattcatcataggaaacaccaaagatgatattttctttaatgg

SEQ ID NO: 18698 - DNA, 138 bp, synthetic construct
  source 1..138: mol_type = other DNA
atctatattcatcataggaagttttagagctagaaatagcaagttaaaataaggctagtccgttatcaacttgaaaaagtggcaccgagtcggtgccattaaagaaaatatcatctttggtgtttcctatgatgaata

SEQ ID NO: 18699 - DNA, 212 bp, synthetic construct
  source 1..212: mol_type = other DNA
tgtatctatattcatcataggaagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcattaaagaaaatatcatctttggtgtttcctatgatgaata

SEQ ID NO: 18700 - DNA, 212 bp, synthetic construct; identical to SEQ ID NO: 18699
  source 1..212: mol_type = other DNA

SEQ ID NO: 18701 - DNA, 187 bp, synthetic construct
  source 1..187: mol_type = other DNA
tctgtatctatattcatcataggagttgtagctccctttctcatttcggaaacgaaatgagaaccgttgctacaataaggccgtctgaaaagatgtgccgcaacgctctgccccttaaagcttctgctttaaggggcatcgtttaattaaagaaaatatcatctttggtgtttcctatgatgaatat

SEQ ID NO: 18702 - DNA, 138 bp, synthetic construct
  source 1..138: mol_type = other DNA
ctggcaccattaaagaaaatgttttagagctagaaatagcaagttaaaataaggctagtccgttatcaacttgaaaaagtggcaccgagtcggtgcttcatcataggaaacaccaaagatgatattttctttaatggt

SEQ ID NO: 18703 - DNA, 138 bp, synthetic construct
  source 1..138: mol_type = other DNA
tatctatattcatcataggagttttagagctagaaatagcaagttaaaataaggctagtccgttatcaacttgaaaaagtggcaccgagtcggtgcattaaagaaaatatcatctttggtgtttcctatgatgaatat

SEQ ID NO: 18704 - DNA, 212 bp, synthetic construct
  source 1..212: mol_type = other DNA
ctgtatctatattcatcataggagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctattaaagaaaatatcatctttggtgtttcctatgatgaatat

SEQ ID NO: 18705 - DNA, 212 bp, synthetic construct; identical to SEQ ID NO: 18704
  source 1..212: mol_type = other DNA

SEQ ID NO: 18706 - DNA, 212 bp, synthetic construct; identical to SEQ ID NO: 18704
  source 1..212: mol_type = other DNA

SEQ ID NO: 18707 - DNA, 177 bp, synthetic construct
  source 1..177: mol_type = other DNA
tatgcctggcaccattaaagaaaagttgtagctccctttttcatttcgcgaaagcgaaatgaaaaacgttgttacaataagagatgaatttctcgcaaagctctgcctcttgaaatttcggtttcaagaggcatctcatcataggaaacaccaaagatgatattttctttaatggtg

SEQ ID NO: 18708 - DNA, 138 bp, synthetic construct
  source 1..138: mol_type = other DNA
cctggcaccattaaagaaaagttttagagctagaaatagcaagttaaaataaggctagtccgttatcaacttgaaaaagtggcaccgagtcggtgctcatcataggaaacaccaaagatgatattttctttaatggtg

SEQ ID NO: 18709 - DNA, 138 bp, synthetic construct
  source 1..138: mol_type = other DNA
gtatctatattcatcatagggttttagagctagaaatagcaagttaaaataaggctagtccgttatcaacttgaaaaagtggcaccgagtcggtgcttaaagaaaatatcatctttggtgtttcctatgatgaatata

SEQ ID NO: 18710 - DNA, 138 bp, synthetic construct
  source 1..138: mol_type = other DNA
gcctggcaccattaaagaaagttttagagctagaaatagcaagttaaaataaggctagtccgttatcaacttgaaaaagtggcaccgagtcggtgccatcataggaaacaccaaagatgatattttctttaatggtgc

SEQ ID NO: 18711 - DNA, 138 bp, synthetic construct
  source 1..138: mol_type = other DNA
tgtatctatattcatcataggttttagagctagaaatagcaagttaaaataaggctagtccgttatcaacttgaaaaagtggcaccgagtcggtgctaaagaaaatatcatctttggtgtttcctatgatgaatatag

SEQ ID NO: 18712 - DNA, 212 bp, synthetic construct
  source 1..212: mol_type = other DNA
tatgcctggcaccattaaagaaagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcatcataggaaacaccaaagatgatattttctttaatggtgc

SEQ ID NO: 18713 - DNA, 212 bp, synthetic construct; identical to SEQ ID NO: 18712
  source 1..212: mol_type = other DNA

SEQ ID NO: 18714 - DNA, 212 bp, synthetic construct
  source 1..212: mol_type = other DNA
ttctgtatctatattcatcataggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttaaagaaaatatcatctttggtgtttcctatgatgaatatag

SEQ ID NO: 18715 - DNA, 139 bp, synthetic construct
  source 1..139: mol_type = other DNA
tctgtatctatattcatcatagttttagtactctggaaacagaatctactaaaacaaggcaaaatgccgtgtttatctcgtcaacttgttggcgagaaaagaaaatatcatctttggtgtttcctatgatgaatataga

SEQ ID NO: 18716 - DNA, 138 bp, synthetic construct
  source 1..138: mol_type = other DNA
ctgtatctatattcatcatagttttagagctagaaatagcaagttaaaataaggctagtccgttatcaacttgaaaaagtggcaccgagtcggtgcaaagaaaatatcatctttggtgtttcctatgatgaatataga

SEQ ID NO: 18717 - DNA, 138 bp, synthetic construct
  source 1..138: mol_type = other DNA
tgcctggcaccattaaagaagttttagagctagaaatagcaagttaaaataaggctagtccgttatcaacttgaaaaagtggcaccgagtcggtgcatcataggaaacaccaaagatgatattttctttaatggtgcc

SEQ ID NO: 18718 - DNA, 138 bp, synthetic construct; identical to SEQ ID NO: 18716
  source 1..138: mol_type = other DNA

SEQ ID NO: 18719 - DNA, 141 bp, synthetic construct
  source 1..141: mol_type = other DNA
gcttctgtatctatattcatcatgttttagtactctggaaacagaatctactaaaacaaggcaaaatgccgtgtttatctcgtcaacttgttggcgagaaagaaaatatcatctttggtgtttcctatgatgaatatagat

SEQ ID NO: 18720 - DNA, 139 bp, synthetic construct
  source 1..139: mol_type = other DNA
ttctgtatctatattcatcatgttttagtactctggaaacagaatctactaaaacaaggcaaaatgccgtgtttatctcgtcaacttgttggcgagaaagaaaatatcatctttggtgtttcctatgatgaatatagat

SEQ ID NO: 18721 - DNA, 138 bp, synthetic construct
  source 1..138: mol_type = other DNA
tctgtatctatattcatcatgttttagagctagaaatagcaagttaaaataaggctagtccgttatcaacttgaaaaagtggcaccgagtcggtgcaagaaaatatcatctttggtgtttcctatgatgaatatagat

SEQ ID NO: 18722 - DNA, 138 bp, synthetic construct; identical to SEQ ID NO: 18721
  source 1..138: mol_type = other DNA

SEQ ID NO: 18723 - DNA, 138 bp, synthetic construct; identical to SEQ ID NO: 18721
  source 1..138: mol_type = other DNA

SEQ ID NO: 18724 - DNA, 138 bp, synthetic construct
  source 1..138: mol_type = other DNA
atgcctggcaccattaaagagttttagagctagaaatagcaagttaaaataaggctagtccgttatcaacttgaaaaagtggcaccgagtcggtgctcataggaaacaccaaagatgatattttctttaatggtgcca

SEQ ID NO: 18725 - DNA, 138 bp, synthetic construct; identical to SEQ ID NO: 18721
  source 1..138: mol_type = other DNA

SEQ ID NO: 18726 - DNA, 141 bp, synthetic construct
  source 1..141: mol_type = other DNA
cgcttctgtatctatattcatcagttttagtactctggaaacagaatctactaaaacaaggcaaaatgccgtgtttatctcgtcaacttgttggcgagaagaaaatatcatctttggtgtttcctatgatgaatatagata

SEQ ID NO: 18727 - DNA, 139 bp, synthetic construct
  source 1..139: mol_type = other DNA
cttctgtatctatattcatcagttttagtactctggaaacagaatctactaaaacaaggcaaaatgccgtgtttatctcgtcaacttgttggcgagaagaaaatatcatctttggtgtttcctatgatgaatatagata

SEQ ID NO: 18728 - DNA, 139 bp, synthetic construct; identical to SEQ ID NO: 18727
  source 1..139: mol_type = other DNA

SEQ ID NO: 18729 - DNA, 139 bp, synthetic construct; identical to SEQ ID NO: 18727
  source 1..139: mol_type = other DNA

SEQ ID NO: 18730 - DNA, 138 bp, synthetic construct
  source 1..138: mol_type = other DNA
ttctgtatctatattcatcagttttagagctagaaatagcaagttaaaataaggctagtccgttatcaacttgaaaaagtggcaccgagtcggtgcagaaaatatcatctttggtgtttcctatgatgaatatagata

SEQ ID NO: 18731 - DNA, 138 bp, synthetic construct
  source 1..138: mol_type = other DNA
tatgcctggcaccattaaaggttttagagctagaaatagcaagttaaaataaggctagtccgttatcaacttgaaaaagtggcaccgagtcggtgccataggaaacaccaaagatgatattttctttaatggtgccag

SEQ ID NO: 18732 - DNA, 138 bp, synthetic construct; identical to SEQ ID NO: 18730
  source 1..138: mol_type = other DNA

SEQ ID NO: 18733 - DNA, 146 bp, synthetic construct
  source 1..146: mol_type = other DNA
ttctgtatctatattcatcagtctttgtactctggtaccagaagctacaaagataaggcttcatgccgaaatcaacaccctgtcattttatggcagggtgttttagaaaatatcatctttggtgtttcctatgatgaatatagata

SEQ ID NO: 18734 - DNA, 139 bp, synthetic construct
  source 1..139: mol_type = other DNA
attatgcctggcaccattaaagttttagtactctggaaacagaatctactaaaacaaggcaaaatgccgtgtttatctcgtcaacttgttggcgagaataggaaacaccaaagatgatattttctttaatggtgccagg

SEQ ID NO: 18735 - DNA, 139 bp, synthetic construct; identical to SEQ ID NO: 18734
  source 1..139: mol_type = other DNA

SEQ ID NO: 18736 - DNA, 139 bp, synthetic construct
  source 1..139: mol_type = other DNA
gcttctgtatctatattcatcgttttagtactctggaaacagaatctactaaaacaaggcaaaatgccgtgtttatctcgtcaacttgttggcgagagaaaatatcatctttggtgtttcctatgatgaatatagatac

SEQ ID NO: 18737 - DNA, 139 bp, synthetic construct; identical to SEQ ID NO: 18736
  source 1..139: mol_type = other DNA

SEQ ID NO: 18738 - DNA, 138 bp, synthetic construct
  source 1..138: mol_type = other DNA
ttatgcctggcaccattaaagttttagagctagaaatagcaagttaaaataaggctagtccgttatcaacttgaaaaagtggcaccgagtcggtgcataggaaacaccaaagatgatattttctttaatggtgccagg

SEQ ID NO: 18739 - DNA, 138 bp, synthetic construct
  source 1..138: mol_type = other DNA
cttctgtatctatattcatcgttttagagctagaaatagcaagttaaaataaggctagtccgttatcaacttgaaaaagtggcaccgagtcggtgcgaaaatatcatctttggtgtttcctatgatgaatatagatac

SEQ ID NO: 18740 - DNA, 146 bp, synthetic construct
  source 1..146: mol_type = other DNA
cttctgtatctatattcatcgtctttgtactctggtaccagaagctacaaagataaggcttcatgccgaaatcaacaccctgtcattttatggcagggtgttttgaaaatatcatctttggtgtttcctatgatgaatatagatac

SEQ ID NO: 18741 - DNA, 139 bp, synthetic construct
  source 1..139: mol_type = other DNA
gattatgcctggcaccattaagttttagtactctggaaacagaatctactaaaacaaggcaaaatgccgtgtttatctcgtcaacttgttggcgagataggaaacaccaaagatgatattttctttaatggtgccaggc

SEQ ID NO: 18742 - DNA, 139 bp, synthetic construct
  source 1..139: mol_type = other DNA
cgcttctgtatctatattcatgttttagtactctggaaacagaatctactaaaacaaggcaaaatgccgtgtttatctcgtcaacttgttggcgagaaaaatatcatctttggtgtttcctatgatgaatatagataca

SEQ ID NO: 18743 - DNA, 138 bp, synthetic construct
  source 1..138: mol_type = other DNA
attatgcctggcaccattaagttttagagctagaaatagcaagttaaaataaggctagtccgttatcaacttgaaaaagtggcaccgagtcggtgctaggaaacaccaaagatgatattttctttaatggtgccaggc

SEQ ID NO: 18744 - DNA, 138 bp, synthetic construct; identical to SEQ ID NO: 18743
  source 1..138: mol_type = other DNA

SEQ ID NO: 18745 - DNA, 138 bp, synthetic construct
  source 1..138: mol_type = other DNA
gcttctgtatctatattcatgttttagagctagaaatagcaagttaaaataaggctagtccgttatcaacttgaaaaagtggcaccgagtcggtgcaaaatatcatctttggtgtttcctatgatgaatatagataca

SEQ ID NO: 18746 - DNA, 141 bp, synthetic construct
  source 1..141: mol_type = other DNA
ctggattatgcctggcaccattagttttagtactctggaaacagaatctactaaaacaaggcaaaatgccgtgtttatctcgtcaacttgttggcgagaaggaaacaccaaagatgatattttctttaatggtgccaggca

SEQ ID NO: 18747 - DNA, 139 bp, synthetic construct
  source 1..139: mol_type = other DNA
ggattatgcctggcaccattagttttagtactctggaaacagaatctactaaaacaaggcaaaatgccgtgtttatctcgtcaacttgttggcgagaaggaaacaccaaagatgatattttctttaatggtgccaggca

SEQ ID NO: 18748 - DNA, 138 bp, synthetic construct
  source 1..138: mol_type = other DNA
gattatgcctggcaccattagttttagagctagaaatagcaagttaaaataaggctagtccgttatcaacttgaaaaagtggcaccgagtcggtgcaggaaacaccaaagatgatattttctttaatggtgccaggca

SEQ ID NO: 18749 - DNA, 138 bp, synthetic construct; identical to SEQ ID NO: 18748
  source 1..138: mol_type = other DNA

SEQ ID NO: 18750 - DNA, 138 bp, synthetic construct
  source 1..138: mol_type = other DNA
cgcttctgtatctatattcagttttagagctagaaatagcaagttaaaataaggctagtccgttatcaacttgaaaaagtggcaccgagtcggtgcaaatatcatctttggtgtttcctatgatgaatatagatacag

SEQ ID NO: 18751 - DNA, 139 bp, synthetic construct
  source 1..139: mol_type = other DNA
tggattatgcctggcaccattgttttagtactctggaaacagaatctactaaaacaaggcaaaatgccgtgtttatctcgtcaacttgttggcgagaggaaacaccaaagatgatattttctttaatggtgccaggcat

SEQ ID NO: 18752 - DNA, 139 bp, synthetic construct; identical to SEQ ID NO: 18751
  source 1..139: mol_type = other DNA

SEQ ID NO: 18753 - DNA, 138 bp, synthetic construct
  source 1..138: mol_type = other DNA
ggattatgcctggcaccattgttttagagctagaaatagcaagttaaaataaggctagtccgttatcaacttgaaaaagtggcaccgagtcggtgcggaaacaccaaagatgatattttctttaatggtgccaggcat

SEQ ID NO: 18754 - DNA, 138 bp, synthetic construct
  source 1..138: mol_type = other DNA
acgcttctgtatctatattcgttttagagctagaaatagcaagttaaaataaggctagtccgttatcaacttgaaaaagtggcaccgagtcggtgcaatatcatctttggtgtttcctatgatgaatatagatacaga

SEQ ID NO: 18755 - DNA, 146 bp, synthetic construct
  source 1..146: mol_type = other DNA
ggattatgcctggcaccattgtctttgtactctggtaccagaagctacaaagataaggcttcatgccgaaatcaacaccctgtcattttatggcagggtgttttggaaacaccaaagatgatattttctttaatggtgccaggcat

SEQ ID NO: 18756 - DNA, 139 bp, synthetic construct
  source 1..139: mol_type = other DNA
ctggattatgcctggcaccatgttttagtactctggaaacagaatctactaaaacaaggcaaaatgccgtgtttatctcgtcaacttgttggcgagagaaacaccaaagatgatattttctttaatggtgccaggcata

SEQ ID NO: 18757 - DNA, 138 bp, synthetic construct
  source 1..138: mol_type = other DNA
tggattatgcctggcaccatgttttagagctagaaatagcaagttaaaataaggctagtccgttatcaacttgaaaaagtggcaccgagtcggtgcgaaacaccaaagatgatattttctttaatggtgccaggcata

SEQ ID NO: 18758 - DNA, 138 bp, synthetic construct
  source 1..138: mol_type = other DNA
gacgcttctgtatctatattgttttagagctagaaatagcaagttaaaataaggctagtccgttatcaacttgaaaaagtggcaccgagtcggtgcatatcatctttggtgtttcctatgatgaatatagatacagaa

SEQ ID NO: 18759 - DNA, 139 bp, synthetic construct
  source 1..139: mol_type = other DNA
cctggattatgcctggcaccagttttagtactctggaaacagaatctactaaaacaaggcaaaatgccgtgtttatctcgtcaacttgttggcgagaaaacaccaaagatgatattttctttaatggtgccaggcataa

SEQ ID NO: 18760 - DNA, 138 bp, synthetic construct
  source 1..138: mol_type = other DNA
ctggattatgcctggcaccagttttagagctagaaatagcaagttaaaataaggctagtccgttatcaacttgaaaaagtggcaccgagtcggtgcaaacaccaaagatgatattttctttaatggtgccaggcataa

SEQ ID NO: 18761 - DNA, 138 bp, synthetic construct
  source 1..138: mol_type = other DNA
tgacgcttctgtatctatatgttttagagctagaaatagcaagttaaaataaggctagtccgttatcaacttgaaaaagtggcaccgagtcggtgctatcatctttggtgtttcctatgatgaatatagatacagaag

SEQ ID NO: 18762 - DNA, 212 bp, synthetic construct
  source 1..212: mol_type = other DNA
tgatgacgcttctgtatctatatgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttatcatctttggtgtttcctatgatgaatatagatacagaag

SEQ ID NO: 18763 - DNA, 212 bp, synthetic construct; identical to SEQ ID NO: 18762
  source 1..212: mol_type = other DNA

SEQ ID NO: 18764 - DNA, 139 bp, synthetic construct
  source 1..139: mol_type = other DNA
tcctggattatgcctggcaccgttttagtactctggaaacagaatctactaaaacaaggcaaaatgccgtgtttatctcgtcaacttgttggcgagaaacaccaaagatgatattttctttaatggtgccaggcataat

SEQ ID NO: 18765 - DNA, 138 bp, synthetic construct
  source 1..138: mol_type = other DNA
cctggattatgcctggcaccgttttagagctagaaatagcaagttaaaataaggctagtccgttatcaacttgaaaaagtggcaccgagtcggtgcaacaccaaagatgatattttctttaatggtgccaggcataat

SEQ ID NO: 18766 - DNA, 138 bp, synthetic construct
  source 1..138: mol_type = other DNA
atgacgcttctgtatctatagttttagagctagaaatagcaagttaaaataaggctagtccgttatcaacttgaaaaagtggcaccgagtcggtgcatcatctttggtgtttcctatgatgaatatagatacagaagc

SEQ ID NO: 18767 - DNA, 138 bp, synthetic construct
  source 1..138: mol_type = other DNA
tcctggattatgcctggcacgttttagagctagaaatagcaagttaaaataaggctagtccgttatcaacttgaaaaagtggcaccgagtcggtgcacaccaaagatgatattttctttaatggtgccaggcataatc

SEQ ID NO: 18768 - DNA, 138 bp, synthetic construct
  source 1..138: mol_type = other DNA
gatgacgcttctgtatctatgttttagagctagaaatagcaagttaaaataaggctagtccgttatcaacttgaaaaagtggcaccgagtcggtgctcatctttggtgtttcctatgatgaatatagatacagaagcg

SEQ ID NO: 18769 - DNA, 138 bp, synthetic construct
  source 1..138: mol_type = other DNA
ttcctggattatgcctggcagttttagagctagaaatagcaagttaaaataaggctagtccgttatcaacttgaaaaagtggcaccgagtcggtgccaccaaagatgatattttctttaatggtgccaggcataatcc

SEQ ID NO: 18770 - DNA, 138 bp, synthetic construct
  source 1..138: mol_type = other DNA
tgatgacgcttctgtatctagttttagagctagaaatagcaagttaaaataaggctagtccgttatcaacttgaaaaagtggcaccgagtcggtgccatctttggtgtttcctatgatgaatatagatacagaagcgt

SEQ ID NO: 18771 - DNA, 212 bp, synthetic construct
  source 1..212: mol_type = other DNA
ctttgatgacgcttctgtatctagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcatctttggtgtttcctatgatgaatatagatacagaagcgt

SEQ ID NO: 18772 - DNA, 138 bp, synthetic construct
  source 1..138: mol_type = other DNA
tttcctggattatgcctggcgttttagagctagaaatagcaagttaaaataaggctagtccgttatcaacttgaaaaagtggcaccgagtcggtgcaccaaagatgatattttctttaatggtgccaggcataatcca

SEQ ID NO: 18773 - DNA, 138 bp, synthetic construct
  source 1..138: mol_type = other DNA
ttgatgacgcttctgtatctgttttagagctagaaatagcaagttaaaataaggctagtccgttatcaacttgaaaaagtggcaccgagtcggtgcatctttggtgtttcctatgatgaatatagatacagaagcgtc

SEQ ID NO: 18774 - DNA, 177 bp, synthetic construct
  source 1..177: mol_type = other DNA
tcagttttcctggattatgcctgggttgtagctccctttttcatttcgcgaaagcgaaatgaaaaacgttgttacaataagagatgaatttctcgcaaagctctgcctcttgaaatttcggtttcaagaggcatcccaaagatgatattttctttaatggtgccaggcataatccag

SEQ ID NO: 18775 - DNA, 138 bp, synthetic construct
  source 1..138: mol_type = other DNA
ttttcctggattatgcctgggttttagagctagaaatagcaagttaaaataaggctagtccgttatcaacttgaaaaagtggcaccgagtcggtgcccaaagatgatattttctttaatggtgccaggcataatccag

SEQ ID NO: 18776 - DNA, 138 bp, synthetic construct
  source 1..138: mol_type = other DNA
tttgatgacgcttctgtatcgttttagagctagaaatagcaagttaaaataaggctagtccgttatcaacttgaaaaagtggcaccgagtcggtgctctttggtgtttcctatgatgaatatagatacagaagcgtca

SEQ ID NO: 18777 - DNA, 177 bp, synthetic construct
  source 1..177: mol_type = other DNA
catgctttgatgacgcttctgtatgttgtagctccctttttcatttcgcgaaagcgaaatgaaaaacgttgttacaataagagatgaatttctcgcaaagctctgcctcttgaaatttcggtttcaagaggcatcctttggtgtttcctatgatgaatatagatacagaagcgtcat

SEQ ID NO: 18778 - DNA, 138 bp, synthetic construct
  source 1..138: mol_type = other DNA
gttttcctggattatgcctggttttagagctagaaatagcaagttaaaataaggctagtccgttatcaacttgaaaaagtggcaccgagtcggtgccaaagatgatattttctttaatggtgccaggcataatccagg

SEQ ID NO: 18779 - DNA, 138 bp, synthetic construct
  source 1..138: mol_type = other DNA
ctttgatgacgcttctgtatgttttagagctagaaatagcaagttaaaataaggctagtccgttatcaacttgaaaaagtggcaccgagtcggtgcctttggtgtttcctatgatgaatatagatacagaagcgtcat

SEQ ID NO: 18780 - DNA, 212 bp, synthetic construct
  source 1..212: mol_type = other DNA
tcagttttcctggattatgcctggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcaaagatgatattttctttaatggtgccaggcataatccagg

SEQ ID NO: 18781 - DNA, 212 bp, synthetic construct; identical to SEQ ID NO: 18780
  source 1..212: mol_type = other DNA

SEQ ID NO: 18782 - DNA, 187 bp, synthetic construct
  source 1..187: mol_type = other DNA
tctcagttttcctggattatgcctgttgtagctccctttctcatttcggaaacgaaatgagaaccgttgctacaataaggccgtctgaaaagatgtgccgcaacgctctgccccttaaagcttctgctttaaggggcatcgtttaaaagatgatattttctttaatggtgccaggcataatccagga

SEQ ID NO: 18783 - DNA, 138 bp, synthetic construct
  source 1..138: mol_type = other DNA
agttttcctggattatgcctgttttagagctagaaatagcaagttaaaataaggctagtccgttatcaacttgaaaaagtggcaccgagtcggtgcaaagatgatattttctttaatggtgccaggcataatccagga

SEQ ID NO: 18784 - DNA, 138 bp, synthetic construct; identical to SEQ ID NO: 18783
  source 1..138: mol_type = other DNA

SEQ ID NO: 18785 - DNA, 138 bp, synthetic construct
  source 1..138: mol_type = other DNA
gctttgatgacgcttctgtagttttagagctagaaatagcaagttaaaataaggctagtccgttatcaacttgaaaaagtggcaccgagtcggtgctttggtgtttcctatgatgaatatagatacagaagcgtcatc

SEQ ID NO: 18786 - DNA, 212 bp, synthetic construct
  source 1..212: mol_type = other DNA
ctcagttttcctggattatgcctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaaagatgatattttctttaatggtgccaggcataatccagga

SEQ ID NO: 18787 - DNA, 212 bp, synthetic construct; identical to SEQ ID NO: 18786
  source 1..212: mol_type = other DNA

SEQ ID NO: 18788 - DNA, 138 bp, synthetic construct
  source 1..138: mol_type = other DNA
cagttttcctggattatgccgttttagagctagaaatagcaagttaaaataaggctagtccgttatcaacttgaaaaagtggcaccgagtcggtgcaagatgatattttctttaatggtgccaggcataatccaggaa

SEQ ID NO: 18789 - DNA, 138 bp, synthetic construct; identical to SEQ ID NO: 18788
  source 1..138: mol_type = other DNA

SEQ ID NO: 18790 - DNA, 138 bp, synthetic construct; identical to SEQ ID NO: 18788
  source 1..138: mol_type = other DNA

SEQ ID NO: 18791 - DNA, 138 bp, synthetic construct; identical to SEQ ID NO: 18788
  source 1..138: mol_type = other DNA

SEQ ID NO: 18792 - DNA, 138 bp, synthetic construct
  source 1..138: mol_type = other DNA
tgctttgatgacgcttctgtgttttagagctagaaatagcaagttaaaataaggctagtccgttatcaacttgaaaaagtggcaccgagtcggtgcttggtgtttcctatgatgaatatagatacagaagcgtcatca

SEQ ID NO: 18793 - DNA, 139 bp, synthetic construct
  source 1..139: mol_type = other DNA
ctcagttttcctggattatgcgttttagtactctggaaacagaatctactaaaacaaggcaaaatgccgtgtttatctcgtcaacttgttggcgagaagatgatattttctttaatggtgccaggcataatccaggaaa

SEQ ID NO: 18794 - DNA, 139 bp, synthetic construct; identical to SEQ ID NO: 18793
  source 1..139: mol_type = other DNA

SEQ ID NO: 18795 - DNA, 138 bp, synthetic construct
  source 1..138: mol_type = other DNA
tcagttttcctggattatgcgttttagagctagaaatagcaagttaaaataaggctagtccgttatcaacttgaaaaagtggcaccgagtcggtgcagatgatattttctttaatggtgccaggcataatccaggaaa

SEQ ID NO: 18796 - DNA, 138 bp, synthetic construct; identical to SEQ ID NO: 18795
  source 1..138: mol_type = other DNA

SEQ ID NO: 18797 - DNA, 138 bp, synthetic construct
  source 1..138: mol_type = other DNA
atgctttgatgacgcttctggttttagagctagaaatagcaagttaaaataaggctagtccgttatcaacttgaaaaagtggcaccgagtcggtgctggtgtttcctatgatgaatatagatacagaagcgtcatcaa

SEQ ID NO: 18798 - DNA, 212 bp, synthetic construct
  source 1..212: mol_type = other DNA
ttctcagttttcctggattatgcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagatgatattttctttaatggtgccaggcataatccaggaaa

SEQ ID NO: 18799 - DNA, 139 bp, synthetic construct
  source 1..139: mol_type = other DNA
tctcagttttcctggattatggttttagtactctggaaacagaatctactaaaacaaggcaaaatgccgtgtttatctcgtcaacttgttggcgagagatgatattttctttaatggtgccaggcataatccaggaaaa

SEQ ID NO: 18800 - DNA, 138 bp, synthetic construct
  source 1..138: mol_type = other DNA
ctcagttttcctggattatggttttagagctagaaatagcaagttaaaataaggctagtccgttatcaacttgaaaaagtggcaccgagtcggtgcgatgatattttctttaatggtgccaggcataatccaggaaaa

SEQ ID NO: 18801 - DNA, 138 bp, synthetic construct
  source 1..138: mol_type = other DNA
catgctttgatgacgcttctgttttagagctagaaatagcaagttaaaataaggctagtccgttatcaacttgaaaaagtggcaccgagtcggtgcggtgtttcctatgatgaatatagatacagaagcgtcatcaaa

SEQ ID NO: 18802 - DNA, 212 bp, synthetic construct
  source 1..212: mol_type = other DNA
tggcatgctttgatgacgcttctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctggtgtttcctatgatgaatatagatacagaagcgtcatcaaa

SEQ ID NO: 18803 - DNA, 212 bp, synthetic construct; identical to SEQ ID NO: 18802
  source 1..212: mol_type = other DNA

SEQ ID NO: 18804 - DNA, 138 bp, synthetic construct
  source 1..138: mol_type = other DNA
gcatgctttgatgacgcttcgttttagagctagaaatagcaagttaaaataaggctagtccgttatcaacttgaaaaagtggcaccgagtcggtgcgtgtttcctatgatgaatatagatacagaagcgtcatcaaag

SEQ ID NO: 18805 - DNA, 138 bp, synthetic construct
  source 1..138: mol_type = other DNA
tctcagttttcctggattatgttttagagctagaaatagcaagttaaaataaggctagtccgttatcaacttgaaaaagtggcaccgagtcggtgcatgatattttctttaatggtgccaggcataatccaggaaaac

SEQ ID NO: 18806 - DNA, 138 bp, synthetic construct; identical to SEQ ID NO: 18804
  source 1..138: mol_type = other DNA

SEQ ID NO: 18807 - DNA, 96 bp, synthetic construct
  source 1..96: mol_type = other DNA
gggtagtgtgaagggttcatgttttagagctagaaatagcaagttaaaataaggctagtccgttatcaacttgaaaaagtggcaccgagtcggtgc

SEQ ID NO: 18808 - DNA, 96 bp, synthetic construct
  source 1..96: mol_type = other DNA
tggtgattatgggagaactggttttagagctagaaatagcaagttaaaataaggctagtccgttatcaacttgaaaaagtggcaccgagtcggtgc

SEQ ID NO: 18809 - DNA, 96 bp, synthetic construct; identical to SEQ ID NO: 18807
  source 1..96: mol_type = other DNA

SEQ ID NO: 18810 - DNA, 96 bp, synthetic construct
  source 1..96: mol_type = other DNA
ggtgattatgggagaactgggttttagagctagaaatagcaagttaaaataaggctagtccgttatcaacttgaaaaagtggcaccgagtcggtgc

SEQ ID NO: 18811 - DNA, 97 bp, synthetic construct
  source 1..97: mol_type = other DNA
gattatgggagaactggagccgttttagtactctggaaacagaatctactaaaacaaggcaaaatgccgtgtttatctcgtcaacttgttggcgaga

SEQ ID NO: 18812 - DNA, 97 bp, synthetic construct; identical to SEQ ID NO: 18811
  source 1..97: mol_type = other DNA

SEQ ID NO: 18813 - DNA, 96 bp, synthetic construct
  source 1..96: mol_type = other DNA
ggtagtgtgaagggttcatagttttagagctagaaatagcaagttaaaataaggctagtccgttatcaacttgaaaaagtggcaccgagtcggtgc

SEQ ID NO: 18814 - DNA, 96 bp, synthetic construct; identical to SEQ ID NO: 18813
  source 1..96: mol_type = other DNA

SEQ ID NO: 18815 - DNA, 96 bp, synthetic construct
  source 1..96: mol_type = other DNA
gtgattatgggagaactggagttttagagctagaaatagcaagttaaaataaggctagtccgttatcaacttgaaaaagtggcaccgagtcggtgc

SEQ ID NO: 18816 - DNA, 135 bp, synthetic construct
  source 1..135: mol_type = other DNA
gtgaagggttcatatgcataatcagttgtagctccctttttcatttcgcgaaagcgaaatgaaaaacgttgttacaataagagatgaatttctcgcaaagctctgcctcttgaaatttcggtttcaagaggcatc

SEQ ID NO: 18817 - DNA, 96 bp, synthetic construct; identical to SEQ ID NO: 18807
  source 1..96: mol_type = other DNA

SEQ ID NO: 18818 - DNA, 96 bp, synthetic construct
  source 1..96: mol_type = other DNA
tataatttgggtagtgtgaagttttagagctagaaatagcaagttaaaataaggctagtccgttatcaacttgaaaaagtggcaccgagtcggtgc

SEQ ID NO: 18819 - DNA, 96 bp, synthetic construct; identical to SEQ ID NO: 18813
  source 1..96: mol_type = other DNA

SEQ ID NO: 18820 - DNA, 96 bp, synthetic construct
  source 1..96: mol_type = other DNA
gtagtgtgaagggttcatatgttttagagctagaaatagcaagttaaaataaggctagtccgttatcaacttgaaaaagtggcaccgagtcggtgc

SEQ ID NO: 18821 - DNA, 96 bp, synthetic construct
  source 1..96: mol_type = other DNA
tgattatgggagaactggaggttttagagctagaaatagcaagttaaaataaggctagtccgttatcaacttgaaaaagtggcaccgagtcggtgc

SEQ ID NO: 18822 - DNA, 97 bp, synthetic construct
  source 1..97: mol_type = other DNA
tatataatttgggtagtgtgagttttagtactctggaaacagaatctactaaaacaaggcaaaatgccgtgtttatctcgtcaacttgttggcgaga

SEQ ID NO: 18823 - DNA, 97 bp, synthetic construct
  source 1..97: mol_type = other DNA
agggttcatatgcataatcaagttttagtactctggaaacagaatctactaaaacaaggcaaaatgccgtgtttatctcgtcaacttgttggcgaga

SEQ ID NO: 18824 - DNA, 96 bp, synthetic construct; identical to SEQ ID NO: 18807
  source 1..96: mol_type = other DNA

SEQ ID NO: 18825 - DNA, 96 bp, synthetic construct
  source 1..96: mol_type = other DNA
tagtgtgaagggttcatatggttttagagctagaaatagcaagttaaaataaggctagtccgttatcaacttgaaaaagtggcaccgagtcggtgc

SEQ ID NO: 18826 - DNA, 96 bp, synthetic construct
  source 1..96: mol_type = other DNA
gattatgggagaactggagcgttttagagctagaaatagcaagttaaaataaggctagtccgttatcaacttgaaaaagtggcaccgagtcggtgc

SEQ ID NO: 18827 - DNA, 97 bp, synthetic construct
  source 1..97: mol_type = other DNA
gtagtgtgaagggttcatatggttttagtactctggaaacagaatctactaaaacaaggcaaaatgccgtgtttatctcgtcaacttgttggcgaga

SEQ ID NO: 18828 - DNA, 97 bp, synthetic construct; identical to SEQ ID NO: 18827
  source 1..97: mol_type = other DNA

SEQ ID NO: 18829 - DNA, 97 bp, synthetic construct; identical to SEQ ID NO: 18811
  source 1..97: mol_type = other DNA

SEQ ID NO: 18830 - DNA, 97 bp, synthetic construct; identical to SEQ ID NO: 18811
  source 1..97: mol_type = other DNA

SEQ ID NO: 18831 - DNA, 96 bp, synthetic construct
  source 1..96: mol_type = other DNA
agtgtgaagggttcatatgcgttttagagctagaaatagcaagttaaaataaggctagtccgttatcaacttgaaaaagtggcaccgagtcggtgc

SEQ ID NO: 18832 - DNA, 96 bp, synthetic construct
  source 1..96: mol_type = other DNA
attatgggagaactggagccgttttagagctagaaatagcaagttaaaataaggctagtccgttatcaacttgaaaaagtggcaccgagtcggtgc

SEQ ID NO: 18833 - DNA, 96 bp, synthetic construct
  source 1..96: mol_type = other DNA
gtgtgaagggttcatatgcagttttagagctagaaatagcaagttaaaataaggctagtccgttatcaacttgaaaaagtggcaccgagtcggtgc

SEQ ID NO: 18834 - DNA, 96 bp, synthetic construct
  source 1..96: mol_type = other DNA
ttatgggagaactggagcctgttttagagctagaaatagcaagttaaaataaggctagtccgttatcaacttgaaaaagtggcaccgagtcggtgc

SEQ ID NO: 18835 - DNA, 96 bp, synthetic construct
  source 1..96: mol_type = other DNA
tgtgaagggttcatatgcatgttttagagctagaaatagcaagttaaaataaggctagtccgttatcaacttgaaaaagtggcaccgagtcggtgc

SEQ ID NO: 18836 - DNA, 96 bp, synthetic construct
  source 1..96: mol_type = other DNA
tatgggagaactggagccttgttttagagctagaaatagcaagttaaaataaggctagtccgttatcaacttgaaaaagtggcaccgagtcggtgc

SEQ ID NO: 18837 - DNA, 170 bp, synthetic construct
  source 1..170: mol_type = other DNA
tggtgattatgggagaactggaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 18838 - DNA, 170 bp, synthetic construct; identical to SEQ ID NO: 18837
  source 1..170: mol_type = other DNA

SEQ ID NO: 18839 - DNA, 145 bp, synthetic construct
  source 1..145: mol_type = other DNA
tctaatggtgattatgggagaactgttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 18840 - DNA, 96 bp, synthetic construct
  source 1..96: mol_type = other DNA
gtgaagggttcatatgcatagttttagagctagaaatagcaagttaaaataaggctagtccgttatcaacttgaaaaagtggcaccgagtcggtgc

SEQ ID NO: 18841 - DNA, 96 bp, synthetic construct
  source 1..96: mol_type = other DNA
atgggagaactggagccttcgttttagagctagaaatagcaagttaaaataaggctagtccgttatcaacttgaaaaagtggcaccgagtcggtgc

SEQ ID NO: 18842 - DNA, 170 bp, synthetic construct; identical to SEQ ID NO: 18837
  source 1..170: mol_type = other DNA

SEQ ID NO: 18843 - DNA, 170 bp, synthetic construct; identical to SEQ ID NO: 18837
  source 1..170: mol_type = other DNA

SEQ ID NO: 18844 - DNA, 170 bp, synthetic construct; identical to SEQ ID NO: 18837
  source 1..170: mol_type = other DNA

SEQ ID NO: 18845 - DNA, 135 bp, synthetic construct; identical to SEQ ID NO: 18816
  source 1..135: mol_type = other DNA

SEQ ID NO: 18846 - DNA, 96 bp, synthetic construct
  source 1..96: mol_type = other DNA
tgaagggttcatatgcataagttttagagctagaaatagcaagttaaaataaggctagtccgttatcaacttgaaaaagtggcaccgagtcggtgc

SEQ ID NO: 18847 - DNA, 96 bp, synthetic construct
  source 1..96: mol_type = other DNA
tgggagaactggagccttcagttttagagctagaaatagcaagttaaaataaggctagtccgttatcaacttgaaaaagtggcaccgagtcggtgc

SEQ ID NO: 18848 - DNA, 96 bp, synthetic construct
  source 1..96: mol_type = other DNA
gaagggttcatatgcataatgttttagagctagaaatagcaagttaaaataaggctagtccgttatcaacttgaaaaagtggcaccgagtcggtgc

SEQ ID NO: 18849 - DNA, 96 bp, synthetic construct
  source 1..96: mol_type = other DNA
gggagaactggagccttcaggttttagagctagaaatagcaagttaaaataaggctagtccgttatcaacttgaaaaagtggcaccgagtcggtgc

SEQ ID NO: 18850 - DNA, 170 bp, synthetic construct
  source 1..170: mol_type = other DNA
gtagtgtgaagggttcatatgcagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 18851 - DNA, 170 bp, synthetic construct; identical to SEQ ID NO: 18850
  source 1..170: mol_type = other DNA

SEQ ID NO: 18852 - DNA, 170 bp, synthetic construct; identical to SEQ ID NO: 18837
  source 1..170: mol_type = other DNA

SEQ ID NO: 18853 - DNA, 97 bp, synthetic construct
  source 1..97: mol_type = other DNA
ggagaactggagccttcagaggttttagtactctggaaacagaatctactaaaacaaggcaaaatgccgtgtttatctcgtcaacttgttggcgaga

SEQ ID NO: 18854 - DNA, 96 bp, synthetic construct
  source 1..96: mol_type = other DNA
ggagaactggagccttcagagttttagagctagaaatagcaagttaaaataaggctagtccgttatcaacttgaaaaagtggcaccgagtcggtgc

SEQ ID NO: 18855 - DNA, 96 bp, synthetic construct
  source 1..96: mol_type = other DNA
aagggttcatatgcataatcgttttagagctagaaatagcaagttaaaataaggctagtccgttatcaacttgaaaaagtggcaccgagtcggtgc

SEQ ID NO: 18856 - DNA, 96 bp, synthetic construct; identical to SEQ ID NO: 18854
  source 1..96: mol_type = other DNA

SEQ ID NO: 18857 - DNA, 99 bp, synthetic construct
  source 1..99: mol_type = other DNA
ttatgggagaactggagccttcagttttagtactctggaaacagaatctactaaaacaaggcaaaatgccgtgtttatctcgtcaacttgttggcgaga

SEQ ID NO: 18858 - DNA, 97 bp, synthetic construct; identical to SEQ ID NO: 18853
  source 1..97: mol_type = other DNA

SEQ ID NO: 18859 - DNA, 96 bp, synthetic construct; identical to SEQ ID NO: 18854
  source 1..96: mol_type = other DNA

SEQ ID NO: 18860 - DNA, 96 bp, synthetic construct; identical to SEQ ID NO: 18854
  source 1..96: mol_type = other DNA

SEQ ID NO: 18861 - DNA, 96 bp, synthetic construct
  source 1..96: mol_type = other DNA
gagaactggagccttcagaggttttagagctagaaatagcaagttaaaataaggctagtccgttatcaacttgaaaaagtggcaccgagtcggtgc

SEQ ID NO: 18862 - DNA, 96 bp, synthetic construct
  source 1..96: mol_type = other DNA
agggttcatatgcataatcagttttagagctagaaatagcaagttaaaataaggctagtccgttatcaacttgaaaaagtggcaccgagtcggtgc

SEQ ID NO: 18863 - DNA, 96 bp, synthetic construct; identical to SEQ ID NO: 18861
  source 1..96: mol_type = other DNA

SEQ ID NO: 18864 - DNA, 99 bp, synthetic construct; identical to SEQ ID NO: 18857
  source 1..99: mol_type = other DNA

SEQ ID NO: 18865 - DNA, 97 bp, synthetic construct
  source 1..97: mol_type = other DNA
gagaactggagccttcagagggttttagtactctggaaacagaatctactaaaacaaggcaaaatgccgtgtttatctcgtcaacttgttggcgaga

SEQ ID NO: 18866 - DNA, 97 bp, synthetic construct
  source 1..97: mol_type = other DNA
tgggagaactggagccttcaggttttagtactctggaaacagaatctactaaaacaaggcaaaatgccgtgtttatctcgtcaacttgttggcgaga

SEQ ID NO: 18867 - DNA, 97 bp, synthetic construct; identical to SEQ ID NO: 18866
  source 1..97: mol_type = other DNA

SEQ ID NO: 18868 - DNA, 96 bp, synthetic construct; identical to SEQ ID NO: 18854
  source 1..96: mol_type = other DNA

SEQ ID NO: 18869 - DNA, 96 bp, synthetic construct
  source 1..96: mol_type = other DNA
gggttcatatgcataatcaagttttagagctagaaatagcaagttaaaataaggctagtccgttatcaacttgaaaaagtggcaccgagtcggtgc

SEQ ID NO: 18870 - DNA, 96 bp, synthetic construct
  source 1..96: mol_type = other DNA
agaactggagccttcagagggttttagagctagaaatagcaagttaaaataaggctagtccgttatcaacttgaaaaagtggcaccgagtcggtgc

SEQ ID NO: 18871 - DNA, 104 bp, synthetic construct
  source 1..104: mol_type = other DNA
gggtaaaattaagcacagtggtctttgtactctggtaccagaagctacaaagataaggcttcatgccgaaatcaacaccctgtcattttatggcagggtgtttt

SEQ ID NO: 18872 - DNA, 97 bp, synthetic construct
  source 1..97: mol_type = other DNA
aagggttcatatgcataatcagttttagtactctggaaacagaatctactaaaacaaggcaaaatgccgtgtttatctcgtcaacttgttggcgaga

SEQ ID NO: 18873 - DNA, 97 bp, synthetic construct; identical to SEQ ID NO: 18872
  source 1..97: mol_type = other DNA

SEQ ID NO: 18874 - DNA, 97 bp, synthetic construct
  source 1..97: mol_type = other DNA
agaactggagccttcagaggggttttagtactctggaaacagaatctactaaaacaaggcaaaatgccgtgtttatctcgtcaacttgttggcgaga

SEQ ID NO: 18875 - DNA, 97 bp, synthetic construct; identical to SEQ ID NO: 18866
  source 1..97: mol_type = other DNA

SEQ ID NO: 18876 - DNA, 96 bp, synthetic construct
  source 1..96: mol_type = other DNA
ggttcatatgcataatcaaagttttagagctagaaatagcaagttaaaataaggctagtccgttatcaacttgaaaaagtggcaccgagtcggtgc

SEQ ID NO: 18877 - DNA, 96 bp, synthetic construct
  source 1..96: mol_type = other DNA
gaactggagccttcagaggggttttagagctagaaatagcaagttaaaataaggctagtccgttatcaacttgaaaaagtggcaccgagtcggtgc

SEQ ID NO: 18878 - DNA, 104 bp, synthetic construct; identical to SEQ ID NO: 18871
  source 1..104: mol_type = other DNA

SEQ ID NO: 18879 - DNA, 97 bp, synthetic construct; identical to SEQ ID NO: 18872
  source 1..97: mol_type = other DNA

SEQ ID NO: 18880 - DNA, 97 bp, synthetic construct; identical to SEQ ID NO: 18874
  source 1..97: mol_type = other DNA

SEQ ID NO: 18881 - DNA, 96 bp, synthetic construct
  source 1..96: mol_type = other DNA
gttcatatgcataatcaaaagttttagagctagaaatagcaagttaaaataaggctagtccgttatcaacttgaaaaagtggcaccgagtcggtgc

SEQ ID NO: 18882 - DNA, 96 bp, synthetic construct; identical to SEQ ID NO: 18881
  source 1..96: mol_type = other DNA

SEQ ID NO: 18883 - DNA, 96 bp, synthetic construct
  source 1..96: mol_type = other DNA
aactggagccttcagagggtgttttagagctagaaatagcaagttaaaataaggctagtccgttatcaacttgaaaaagtggcaccgagtcggtgc

SEQ ID NO: 18884 - DNA, 99 bp, synthetic construct
  source 1..99: mol_type = other DNA
aaatatataatttgggtagtgtggttttagtactctggaaacagaatctactaaaacaaggcaaaatgccgtgtttatctcgtcaacttgttggcgaga

SEQ ID NO: 18885 - DNA, 97 bp, synthetic construct; identical to SEQ ID NO: 18872
  source 1..97: mol_type = other DNA

SEQ ID NO: 18886 - DNA, 96 bp, synthetic construct; identical to SEQ ID NO: 18876
  source 1..96: mol_type = other DNA

SEQ ID NO: 18887 - DNA, 96 bp, synthetic construct
  source 1..96: mol_type = other DNA
ttcatatgcataatcaaaaagttttagagctagaaatagcaagttaaaataaggctagtccgttatcaacttgaaaaagtggcaccgagtcggtgc

SEQ ID NO: 18888 - DNA, 96 bp, synthetic construct
  source 1..96: mol_type = other DNA
actggagccttcagagggtagttttagagctagaaatagcaagttaaaataaggctagtccgttatcaacttgaaaaagtggcaccgagtcggtgc

SEQ ID NO: 18889 - DNA, 97 bp, synthetic construct; identical to SEQ ID NO: 18872
  source 1..97: mol_type = other DNA

SEQ ID NO: 18890 - DNA, 97 bp, synthetic construct; identical to SEQ ID NO: 18823
  source 1..97: mol_type = other DNA

SEQ ID NO: 18891 - DNA, 96 bp, synthetic construct
  source 1..96: mol_type = other DNA
tcatatgcataatcaaaaaggttttagagctagaaatagcaagttaaaataaggctagtccgttatcaacttgaaaaagtggcaccgagtcggtgc

SEQ ID NO: 18892 - DNA, 96 bp, synthetic construct
  source 1..96: mol_type = other DNA
ctggagccttcagagggtaagttttagagctagaaatagcaagttaaaataaggctagtccgttatcaacttgaaaaagtggcaccgagtcggtgc

SEQ ID NO: 18893 - DNA, 84 bp, synthetic construct
  source 1..84: mol_type = other DNA
gtctttgtactctggtaccagaagctacaaagataaggcttcatgccgaaatcaacaccctgtcattttatggcagggtgtttt

SEQ ID NO: 18894 - DNA, 97 bp, synthetic construct
  source 1..97: mol_type = other DNA
tgcataatcaaaaagttttcagttttagtactctggaaacagaatctactaaaacaaggcaaaatgccgtgtttatctcgtcaacttgttggcgaga

SEQ ID NO: 18895 - DNA, 96 bp, synthetic construct
  source 1..96: mol_type = other DNA
catatgcataatcaaaaagtgttttagagctagaaatagcaagttaaaataaggctagtccgttatcaacttgaaaaagtggcaccgagtcggtgc

SEQ ID NO: 18896 - DNA, 96 bp, synthetic construct
  source 1..96: mol_type = other DNA
tggagccttcagagggtaaagttttagagctagaaatagcaagttaaaataaggctagtccgttatcaacttgaaaaagtggcaccgagtcggtgc

SEQ ID NO: 18897 - DNA, 97 bp, synthetic construct; identical to SEQ ID NO: 18894
  source 1..97: mol_type = other DNA

SEQ ID NO: 18898 - DNA, 96 bp, synthetic construct
  source 1..96: mol_type = other DNA
atatgcataatcaaaaagttgttttagagctagaaatagcaagttaaaataaggctagtccgttatcaacttgaaaaagtggcaccgagtcggtgc

SEQ ID NO: 18899 - DNA, 96 bp, synthetic construct
  source 1..96: mol_type = other DNA
ggagccttcagagggtaaaagttttagagctagaaatagcaagttaaaataaggctagtccgttatcaacttgaaaaagtggcaccgagtcggtgc

SEQ ID NO: 18900 - DNA, 170 bp, synthetic construct
  source 1..170: mol_type = other DNA
ctggagccttcagagggtaaaatgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 18901 - DNA, 170 bp, synthetic construct; identical to SEQ ID NO: 18900
  source 1..170: mol_type = other DNA

SEQ ID NO: 18902 - DNA, 97 bp, synthetic construct; identical to SEQ ID NO: 18894
  source 1..97: mol_type = other DNA

SEQ ID NO: 18903 - DNA, 96 bp, synthetic construct
  source 1..96: mol_type = other DNA
tatgcataatcaaaaagtttgttttagagctagaaatagcaagttaaaataaggctagtccgttatcaacttgaaaaagtggcaccgagtcggtgc

SEQ ID NO: 18904 - DNA, 96 bp, synthetic construct
  source 1..96: mol_type = other DNA
gagccttcagagggtaaaatgttttagagctagaaatagcaagttaaaataaggctagtccgttatcaacttgaaaaagtggcaccgagtcggtgc

SEQ ID NO: 18905 - DNA, 96 bp, synthetic construct
  source 1..96: mol_type = other DNA
atgcataatcaaaaagttttgttttagagctagaaatagcaagttaaaataaggctagtccgttatcaacttgaaaaagtggcaccgagtcggtgc

SEQ ID NO: 18906 - DNA, 96 bp, synthetic construct
  source 1..96: mol_type = other DNA
agccttcagagggtaaaattgttttagagctagaaatagcaagttaaaataaggctagtccgttatcaacttgaaaaagtggcaccgagtcggtgc

SEQ ID NO: 18907 - DNA, 96 bp, synthetic construct
  source 1..96: mol_type = other DNA
tgcataatcaaaaagttttcgttttagagctagaaatagcaagttaaaataaggctagtccgttatcaacttgaaaaagtggcaccgagtcggtgc

SEQ ID NO: 18908 - DNA, 96 bp, synthetic construct
  source 1..96: mol_type = other DNA
gccttcagagggtaaaattagttttagagctagaaatagcaagttaaaataaggctagtccgttatcaacttgaaaaagtggcaccgagtcggtgc

SEQ ID NO: 18909 - DNA, 170 bp, synthetic construct
  source 1..170: mol_type = other DNA
ggagccttcagagggtaaaattagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 18910 - DNA, 96 bp, synthetic construct
  source 1..96: mol_type = other DNA
gcataatcaaaaagttttcagttttagagctagaaatagcaagttaaaataaggctagtccgttatcaacttgaaaaagtggcaccgagtcggtgc

SEQ ID NO: 18911 - DNA, 96 bp, synthetic construct
  source 1..96: mol_type = other DNA
ccttcagagggtaaaattaagttttagagctagaaatagcaagttaaaataaggctagtccgttatcaacttgaaaaagtggcaccgagtcggtgc

SEQ ID NO: 18912 - DNA, 135 bp, synthetic construct
  source 1..135: mol_type = other DNA
atatgcataatcaaaaagttttcagttgtagctccctttttcatttcgcgaaagcgaaatgaaaaacgttgttacaataagagatgaatttctcgcaaagctctgcctcttgaaatttcggtttcaagaggcatc

SEQ ID NO: 18913 - DNA, 96 bp, synthetic construct
  source 1..96: mol_type = other DNA
cataatcaaaaagttttcacgttttagagctagaaatagcaagttaaaataaggctagtccgttatcaacttgaaaaagtggcaccgagtcggtgc

SEQ ID NO: 18914 - DNA, 96 bp, synthetic construct
  source 1..96: mol_type = other DNA
cttcagagggtaaaattaaggttttagagctagaaatagcaagttaaaataaggctagtccgttatcaacttgaaaaagtggcaccgagtcggtgc

SEQ ID NO: 18915 - DNA, 135 bp, synthetic construct
  source 1..135: mol_type = other DNA
agagggtaaaattaagcacagtgggttgtagctccctttttcatttcgcgaaagcgaaatgaaaaacgttgttacaataagagatgaatttctcgcaaagctctgcctcttgaaatttcggtttcaagaggcatc

SEQ ID NO: 18916 - DNA, 96 bp, synthetic construct
  source 1..96: mol_type = other DNA
ataatcaaaaagttttcacagttttagagctagaaatagcaagttaaaataaggctagtccgttatcaacttgaaaaagtggcaccgagtcggtgc

SEQ ID NO: 18917 - DNA, 96 bp, synthetic construct
  source 1..96: mol_type = other DNA
ttcagagggtaaaattaagcgttttagagctagaaatagcaagttaaaataaggctagtccgttatcaacttgaaaaagtggcaccgagtcggtgc

SEQ ID NO: 18918 - DNA, 170 bp, synthetic construct
  source 1..170: mol_type = other DNA
cataatcaaaaagttttcacatagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 18919 - DNA, 170 bp, synthetic construct; identical to SEQ ID NO: 18918
  source 1..170: mol_type = other DNA

SEQ ID NO: 18920 - DNA, 145 bp, synthetic construct
  source 1..145: mol_type = other DNA
aatcaaaaagttttcacatagtttgttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 18921 - DNA, 96 bp, synthetic construct
  source 1..96: mol_type = other DNA
taatcaaaaagttttcacatgttttagagctagaaatagcaagttaaaataaggctagtccgttatcaacttgaaaaagtggcaccgagtcggtgc

SEQ ID NO: 18922 - DNA, 96 bp, synthetic construct; identical to SEQ ID NO: 18921
  source 1..96: mol_type = other DNA

SEQ ID NO: 18923 - DNA, 96 bp, synthetic construct
  source 1..96: mol_type = other DNA
tcagagggtaaaattaagcagttttagagctagaaatagcaagttaaaataaggctagtccgttatcaacttgaaaaagtggcaccgagtcggtgc

SEQ ID NO: 18924 - DNA, 170 bp, synthetic construct; identical to SEQ ID NO: 18918
  source 1..170: mol_type = other DNA

SEQ ID NO: 18925 - DNA, 170 bp, synthetic construct; identical to SEQ ID NO: 18918
  source 1..170: mol_type = other DNA

SEQ ID NO: 18926 - DNA, 96 bp, synthetic construct; identical to SEQ ID NO: 18916
  source 1..96: mol_type = other DNA

SEQ ID NO: 18927 - DNA, 96 bp, synthetic construct
  source 1..96: mol_type = other DNA
agtttcttacctcttctagtgttttagagctagaaatagcaagttaaaataaggctagtccgttatcaacttgaaaaagtggcaccgagtcggtgc

SEQ ID NO: 18928 - DNA, 96 bp, synthetic construct; identical to SEQ ID NO: 18921
  source 1..96: mol_type = other DNA

SEQ ID NO: 18929 - DNA, 96 bp, synthetic construct
  source 1..96: mol_type = other DNA
aatcaaaaagttttcacatagttttagagctagaaatagcaagttaaaataaggctagtccgttatcaacttgaaaaagtggcaccgagtcggtgc

SEQ ID NO: 18930 - DNA, 96 bp, synthetic construct
  source 1..96: mol_type = other DNA
cagagggtaaaattaagcacgttttagagctagaaatagcaagttaaaataaggctagtccgttatcaacttgaaaaagtggcaccgagtcggtgc

SEQ ID NO: 18931 - DNA, 97 bp, synthetic construct
  source 1..97: mol_type = other DNA
atagtttcttacctcttctaggttttagtactctggaaacagaatctactaaaacaaggcaaaatgccgtgtttatctcgtcaacttgttggcgaga

SEQ ID NO: 18932 - DNA, 97 bp, synthetic construct
  source 1..97: mol_type = other DNA
gcataatcaaaaagttttcacgttttagtactctggaaacagaatctactaaaacaaggcaaaatgccgtgtttatctcgtcaacttgttggcgaga

SEQ ID NO: 18933 - DNA, 96 bp, synthetic construct; identical to SEQ ID NO: 18916
  source 1..96: mol_type = other DNA

SEQ ID NO: 18934 - DNA, 96 bp, synthetic construct
  source 1..96: mol_type = other DNA
atcaaaaagttttcacataggttttagagctagaaatagcaagttaaaataaggctagtccgttatcaacttgaaaaagtggcaccgagtcggtgc

SEQ ID NO: 18935 - DNA, 96 bp, synthetic construct
  source 1..96: mol_type = other DNA
agagggtaaaattaagcacagttttagagctagaaatagcaagttaaaataaggctagtccgttatcaacttgaaaaagtggcaccgagtcggtgc

SEQ ID NO: 18936 - DNA, 170 bp, synthetic construct; identical to SEQ ID NO: 18918
  source 1..170: mol_type = other DNA

SEQ ID NO: 18937 - DNA, 97 bp, synthetic construct; identical to SEQ ID NO: 18894
  source 1..97: mol_type = other DNA

SEQ ID NO: 18938 - DNA, 96 bp, synthetic construct
  source 1..96: mol_type = other DNA
tcaaaaagttttcacatagtgttttagagctagaaatagcaagttaaaataaggctagtccgttatcaacttgaaaaagtggcaccgagtcggtgc

SEQ ID NO: 18939 - DNA, 96 bp, synthetic construct
  source 1..96: mol_type = other DNA
gagggtaaaattaagcacaggttttagagctagaaatagcaagttaaaataaggctagtccgttatcaacttgaaaaagtggcaccgagtcggtgc

SEQ ID NO: 18940 - DNA, 170 bp, synthetic construct; identical to SEQ ID NO: 18909
  source 1..170: mol_type = other DNA

SEQ ID NO: 18941 - DNA, 170 bp, synthetic construct; identical to SEQ ID NO: 18909
  source 1..170: mol_type = other DNA

SEQ ID NO: 18942 - DNA, 96 bp, synthetic construct
  source 1..96: mol_type = other DNA
agggtaaaattaagcacagtgttttagagctagaaatagcaagttaaaataaggctagtccgttatcaacttgaaaaagtggcaccgagtcggtgc

SEQ ID NO: 18943 - DNA, 96 bp, synthetic construct
  source 1..96: mol_type = other DNA
caaaaagttttcacatagttgttttagagctagaaatagcaagttaaaataaggctagtccgttatcaacttgaaaaagtggcaccgagtcggtgc

SEQ ID NO: 18944 - DNA, 96 bp, synthetic construct; identical to SEQ ID NO: 18942
  source 1..96: mol_type = other DNA

SEQ ID NO: 18945 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
tctgtatctatattcatcataggagttgtagctcccgaaacgttgctacaataaggccgtctgaaaagatgtgccgcaacgctctgccccttaaagcttctgctttaaggggcatcgtt

SEQ ID NO: 18946 - RNA, 99 nt, synthetic construct
  source 1..99: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 96: mod_base = OTHER; note = internucleotide phosphorothioate linkage
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide
gcttctgtatctatattcatcatgttttagtactctggaaacagaatctactaaaacaaggcaaaatgccgtgtttatctcgtcaacttgttggcgaga

SEQ ID NO: 18947 - RNA, 99 nt, synthetic construct
  source 1..99: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 96: mod_base = OTHER; note = internucleotide phosphorothioate linkage
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide
cgcttctgtatctatattcatcagttttagtactctggaaacagaatctactaaaacaaggcaaaatgccgtgtttatctcgtcaacttgttggcgaga

SEQ ID NO: 18948 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
atattcatcataggaaacaccgttttagtactctggaaacagaatctactaaaacaaggcaaaatgccgtgtttatctcgtcaacttgttggcgaga

SEQ ID NO: 18949 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
ggcaccattaaagaaaatatcgttttagtactctggaaacagaatctactaaaacaaggcaaaatgccgtgtttatctcgtcaacttgttggcgaga

SEQ ID NO: 18950 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
tctatattcatcataggaaacgttttagtactctggaaacagaatctactaaaacaaggcaaaatgccgtgtttatctcgtcaacttgttggcgaga

SEQ ID NO: 18951 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
tctgtatctatattcatcatagttttagtactctggaaacagaatctactaaaacaaggcaaaatgccgtgtttatctcgtcaacttgttggcgaga

SEQ ID NO: 18952 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
ttctgtatctatattcatcatgttttagtactctggaaacagaatctactaaaacaaggcaaaatgccgtgtttatctcgtcaacttgttggcgaga

SEQ ID NO: 18953 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
cttctgtatctatattcatcagttttagtactctggaaacagaatctactaaaacaaggcaaaatgccgtgtttatctcgtcaacttgttggcgaga

SEQ ID NO: 18954 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
attatgcctggcaccattaaagttttagtactctggaaacagaatctactaaaacaaggcaaaatgccgtgtttatctcgtcaacttgttggcgaga

SEQ ID NO: 18955 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
gcttctgtatctatattcatcgttttagtactctggaaacagaatctactaaaacaaggcaaaatgccgtgtttatctcgtcaacttgttggcgaga

SEQ ID NO: 18956 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
gattatgcctggcaccattaagttttagtactctggaaacagaatctactaaaacaaggcaaaatgccgtgtttatctcgtcaacttgttggcgaga

SEQ ID NO: 18957 - RNA, 97 nt, synthetic construct
  source 1..97: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 94: mod_base = OTHER; note = internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide with internucleotide phosphorothioate linkage
  modified_base 97: mod_base = OTHER; note = 2'-O-methyl nucleotide
cgcttctgtatctatattcatgttttagtactctggaaacagaatctactaaaacaaggcaaaatgccgtgtttatctcgtcaacttgttggcgaga

SEQ ID NO: 18958 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgc

SEQ ID NO: 18959 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tctgtatctatattcatcatgttttagagctagaaatagcaagttaaaataaggctagtccgttatcaacttgaaaaagtggcaccgagtcggtgc

SEQ ID NO: 18960 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
cagttttcctggattatgccgttttagagctagaaatagcaagttaaaataaggctagtccgttatcaacttgaaaaagtggcaccgagtcggtgc

SEQ ID NO: 18961 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ttcatcataggaaacaccaagttttagagctagaaatagcaagttaaaataaggctagtccgttatcaacttgaaaaagtggcaccgagtcggtgc

SEQ ID NO: 18962 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
cattaaagaaaatatcattggttttagagctagaaatagcaagttaaaataaggctagtccgttatcaacttgaaaaagtggcaccgagtcggtgc

SEQ ID NO: 18963 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
attcatcataggaaacaccagttttagagctagaaatagcaagttaaaataaggctagtccgttatcaacttgaaaaagtggcaccgagtcggtgc

SEQ ID NO: 18964 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ccattaaagaaaatatcattgttttagagctagaaatagcaagttaaaataaggctagtccgttatcaacttgaaaaagtggcaccgagtcggtgc

SEQ ID NO: 18965 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tattcatcataggaaacaccgttttagagctagaaatagcaagttaaaataaggctagtccgttatcaacttgaaaaagtggcaccgagtcggtgc

SEQ ID NO: 18966 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
atattcatcataggaaacacgttttagagctagaaatagcaagttaaaataaggctagtccgttatcaacttgaaaaagtggcaccgagtcggtgc

SEQ ID NO: 18967 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
caccattaaagaaaatatcagttttagagctagaaatagcaagttaaaataaggctagtccgttatcaacttgaaaaagtggcaccgagtcggtgc

SEQ ID NO: 18968 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tatattcatcataggaaacagttttagagctagaaatagcaagttaaaataaggctagtccgttatcaacttgaaaaagtggcaccgagtcggtgc

SEQ ID NO: 18969 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
gcaccattaaagaaaatatcgttttagagctagaaatagcaagttaaaataaggctagtccgttatcaacttgaaaaagtggcaccgagtcggtgc

SEQ ID NO: 18970 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ctatattcatcataggaaacgttttagagctagaaatagcaagttaaaataaggctagtccgttatcaacttgaaaaagtggcaccgagtcggtgc

SEQ ID NO: 18971 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ggcaccattaaagaaaatatgttttagagctagaaatagcaagttaaaataaggctagtccgttatcaacttgaaaaagtggcaccgagtcggtgc

SEQ ID NO: 18972 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tctatattcatcataggaaagttttagagctagaaatagcaagttaaaataaggctagtccgttatcaacttgaaaaagtggcaccgagtcggtgc

SEQ ID NO: 18973 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tggcaccattaaagaaaatagttttagagctagaaatagcaagttaaaataaggctagtccgttatcaacttgaaaaagtggcaccgagtcggtgc

SEQ ID NO: 18974 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
atctatattcatcataggaagttttagagctagaaatagcaagttaaaataaggctagtccgttatcaacttgaaaaagtggcaccgagtcggtgc

SEQ ID NO: 18975 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ctggcaccattaaagaaaatgttttagagctagaaatagcaagttaaaataaggctagtccgttatcaacttgaaaaagtggcaccgagtcggtgc

SEQ ID NO: 18976 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tatctatattcatcataggagttttagagctagaaatagcaagttaaaataaggctagtccgttatcaacttgaaaaagtggcaccgagtcggtgc

SEQ ID NO: 18977 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
cctggcaccattaaagaaaagttttagagctagaaatagcaagttaaaataaggctagtccgttatcaacttgaaaaagtggcaccgagtcggtgc

SEQ ID NO: 18978 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
gtatctatattcatcatagggttttagagctagaaatagcaagttaaaataaggctagtccgttatcaacttgaaaaagtggcaccgagtcggtgc

SEQ ID NO: 18979 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
gcctggcaccattaaagaaagttttagagctagaaatagcaagttaaaataaggctagtccgttatcaacttgaaaaagtggcaccgagtcggtgc

SEQ ID NO: 18980 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tgtatctatattcatcataggttttagagctagaaatagcaagttaaaataaggctagtccgttatcaacttgaaaaagtggcaccgagtcggtgc

SEQ ID NO: 18981 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tgcctggcaccattaaagaagttttagagctagaaatagcaagttaaaataaggctagtccgttatcaacttgaaaaagtggcaccgagtcggtgc

SEQ ID NO: 18982 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ctgtatctatattcatcatagttttagagctagaaatagcaagttaaaataaggctagtccgttatcaacttgaaaaagtggcaccgagtcggtgc

SEQ ID NO: 18983 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
atgcctggcaccattaaagagttttagagctagaaatagcaagttaaaataaggctagtccgttatcaacttgaaaaagtggcaccgagtcggtgc

SEQ ID NO: 18984 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
tatgcctggcaccattaaaggttttagagctagaaatagcaagttaaaataaggctagtccgttatcaacttgaaaaagtggcaccgagtcggtgc

SEQ ID NO: 18985 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ttctgtatctatattcatcagttttagagctagaaatagcaagttaaaataaggctagtccgttatcaacttgaaaaagtggcaccgagtcggtgc

SEQ ID NO: 18986 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
ttatgcctggcaccattaaagttttagagctagaaatagcaagttaaaataaggctagtccgttatcaacttgaaaaagtggcaccgagtcggtgc

SEQ ID NO: 18987 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
cttctgtatctatattcatcgttttagagctagaaatagcaagttaaaataaggctagtccgttatcaacttgaaaaagtggcaccgagtcggtgc

SEQ ID NO: 18988 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
attatgcctggcaccattaagttttagagctagaaatagcaagttaaaataaggctagtccgttatcaacttgaaaaagtggcaccgagtcggtgc

SEQ ID NO: 18989 - RNA, 96 nt, synthetic construct
  source 1..96: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 93: mod_base = OTHER; note = internucleotide phosphorothioate linkage
  modified_base 94: mod_base = OTHER; note = 2'-O-methyl nucleotide with internucleotide phosphorothioate linkage
  modified_base 95: mod_base = OTHER; note = 2'-O-methyl nucleotide with internucleotide phosphorothioate linkage
  modified_base 96: mod_base = OTHER; note = 2'-O-methyl nucleotide
gcttctgtatctatattcatgttttagagctagaaatagcaagttaaaataaggctagtccgttatcaacttgaaaaagtggcaccgagtcggtgc

SEQ ID NO: 18990 - RNA, 104 nt, synthetic construct
  source 1..104: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 101: mod_base = OTHER; note = internucleotide phosphorothioate linkage
  modified_base 102: mod_base = OTHER; note = 2'-O-methyl nucleotide with internucleotide phosphorothioate linkage
  modified_base 103: mod_base = OTHER; note = 2'-O-methyl nucleotide with internucleotide phosphorothioate linkage
  modified_base 104: mod_base = OTHER; note = 2'-O-methyl nucleotide
ttctgtatctatattcatcagtctttgtactctggtaccagaagctacaaagataaggcttcatgccgaaatcaacaccctgtcattttatggcagggtgtttt

SEQ ID NO: 18991 - RNA, 104 nt, synthetic construct
  source 1..104: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 101: mod_base = OTHER; note = internucleotide phosphorothioate linkage
  modified_base 102: mod_base = OTHER; note = 2'-O-methyl nucleotide with internucleotide phosphorothioate linkage
  modified_base 103: mod_base = OTHER; note = 2'-O-methyl nucleotide with internucleotide phosphorothioate linkage
  modified_base 104: mod_base = OTHER; note = 2'-O-methyl nucleotide
cttctgtatctatattcatcgtctttgtactctggtaccagaagctacaaagataaggcttcatgccgaaatcaacaccctgtcattttatggcagggtgtttt

SEQ ID NO: 18992 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatgg

SEQ ID NO: 18993 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatg

SEQ ID NO: 18994 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaat

SEQ ID NO: 18995 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaa

SEQ ID NO: 18996 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttcttta

SEQ ID NO: 18997 - RNA, 116 nt, synthetic construct
  source 1..116: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 113: mod_base = OTHER; note = internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttcttt

SEQ ID NO: 18998 - RNA, 115 nt, synthetic construct
  source 1..115: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 112: mod_base = OTHER; note = internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctt

SEQ ID NO: 18999 - RNA, 114 nt, synthetic construct
  source 1..114: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 111: mod_base = OTHER; note = internucleotide phosphorothioate linkage
  modified_base 112: mod_base = OTHER; note = 2'-O-methyl nucleotide with internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttct

SEQ ID NO: 19000 - RNA, 113 nt, synthetic construct
  source 1..113: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 110: mod_base = OTHER; note = internucleotide phosphorothioate linkage
  modified_base 111: mod_base = OTHER; note = 2'-O-methyl nucleotide with internucleotide phosphorothioate linkage
  modified_base 112: mod_base = OTHER; note = 2'-O-methyl nucleotide with internucleotide phosphorothioate linkage
  modified_base 113: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttc

SEQ ID NO: 19001 - RNA, 112 nt, synthetic construct
  source 1..112: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 109: mod_base = OTHER; note = internucleotide phosphorothioate linkage
  modified_base 110: mod_base = OTHER; note = 2'-O-methyl nucleotide with internucleotide phosphorothioate linkage
  modified_base 111: mod_base = OTHER; note = 2'-O-methyl nucleotide with internucleotide phosphorothioate linkage
  modified_base 112: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatatttt

SEQ ID NO: 19002 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatgg

SEQ ID NO: 19003 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatg

SEQ ID NO: 19004 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaat

SEQ ID NO: 19005 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaa

SEQ ID NO: 19006 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttcttta

SEQ ID NO: 19007 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttcttt

SEQ ID NO: 19008 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctt

SEQ ID NO: 19009 - RNA, 116 nt, synthetic construct
  source 1..116: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 113: mod_base = OTHER; note = internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttct

SEQ ID NO: 19010 - RNA, 115 nt, synthetic construct
  source 1..115: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 112: mod_base = OTHER; note = internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttc

SEQ ID NO: 19011 - RNA, 114 nt, synthetic construct
  source 1..114: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 111: mod_base = OTHER; note = internucleotide phosphorothioate linkage
  modified_base 112: mod_base = OTHER; note = 2'-O-methyl nucleotide with internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatatttt

SEQ ID NO: 19012 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatgg

SEQ ID NO: 19013 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatg

SEQ ID NO: 19014 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaat

SEQ ID NO: 19015 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaa

SEQ ID NO: 19016 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttcttta

SEQ ID NO: 19017 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttcttt

SEQ ID NO: 19018 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctt

SEQ ID NO: 19019 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttct

SEQ ID NO: 19020 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttc

SEQ ID NO: 19021 - RNA, 116 nt, synthetic construct
  source 1..116: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 113: mod_base = OTHER; note = internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatatttt

SEQ ID NO: 19022 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatgg

SEQ ID NO: 19023 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatg

SEQ ID NO: 19024 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaat

SEQ ID NO: 19025 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaa

SEQ ID NO: 19026 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttcttta

SEQ ID NO: 19027 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttcttt

SEQ ID NO: 19028 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctt

SEQ ID NO: 19029 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttct

SEQ ID NO: 19030 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttc

SEQ ID NO: 19031 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatatttt

SEQ ID NO: 19032 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatgg

SEQ ID NO: 19033 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatg

SEQ ID NO: 19034 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaat

SEQ ID NO: 19035 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaa

SEQ ID NO: 19036 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttcttta

SEQ ID NO: 19037 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttcttt

SEQ ID NO: 19038 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctt

SEQ ID NO: 19039 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttct

SEQ ID NO: 19040 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttc

SEQ ID NO: 19041 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatatttt

SEQ ID NO: 19042 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatgg

SEQ ID NO: 19043 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatg

SEQ ID NO: 19044 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaat

SEQ ID NO: 19045 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaa

SEQ ID NO: 19046 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttcttta

SEQ ID NO: 19047 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttcttt

SEQ ID NO: 19048 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctt

SEQ ID NO: 19049 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttct

SEQ ID NO: 19050 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttc

SEQ ID NO: 19051 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatatttt

SEQ ID NO: 19052 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatgg

SEQ ID NO: 19053 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatg

SEQ ID NO: 19054 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaat

SEQ ID NO: 19055 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaa

SEQ ID NO: 19056 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttcttta

SEQ ID NO: 19057 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttcttt

SEQ ID NO: 19058 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctt

SEQ ID NO: 19059 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttct

SEQ ID NO: 19060 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttc

SEQ ID NO: 19061 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatatttt

SEQ ID NO: 19062 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatgg

SEQ ID NO: 19063 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatg

SEQ ID NO: 19064 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaat

SEQ ID NO: 19065 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaa

SEQ ID NO: 19066 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttcttta

SEQ ID NO: 19067 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttcttt

SEQ ID NO: 19068 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctt

SEQ ID NO: 19069 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttct

SEQ ID NO: 19070 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttc

SEQ ID NO: 19071 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatatttt

SEQ ID NO: 19072 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatgg

SEQ ID NO: 19073 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatg

SEQ ID NO: 19074 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaat

SEQ ID NO: 19075 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaa

SEQ ID NO: 19076 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttcttta

SEQ ID NO: 19077 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttcttt

SEQ ID NO: 19078 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctt

SEQ ID NO: 19079 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttct

SEQ ID NO: 19080 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttc

SEQ ID NO: 19081 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatatttt

SEQ ID NO: 19082 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatgg

SEQ ID NO: 19083 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatg

SEQ ID NO: 19084 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaat

SEQ ID NO: 19085 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaa

SEQ ID NO: 19086 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttcttta

SEQ ID NO: 19087 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttcttt

SEQ ID NO: 19088 - RNA, 116 nt, synthetic construct
  source 1..116: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 113: mod_base = OTHER; note = internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctt

SEQ ID NO: 19089 - RNA, 115 nt, synthetic construct
  source 1..115: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 112: mod_base = OTHER; note = internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttct

SEQ ID NO: 19090 - RNA, 114 nt, synthetic construct
  source 1..114: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 111: mod_base = OTHER; note = internucleotide phosphorothioate linkage
  modified_base 112: mod_base = OTHER; note = 2'-O-methyl nucleotide with internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttc

SEQ ID NO: 19091 - RNA, 113 nt, synthetic construct
  source 1..113: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 110: mod_base = OTHER; note = internucleotide phosphorothioate linkage
  modified_base 111: mod_base = OTHER; note = 2'-O-methyl nucleotide with internucleotide phosphorothioate linkage
  modified_base 112: mod_base = OTHER; note = 2'-O-methyl nucleotide with internucleotide phosphorothioate linkage
  modified_base 113: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatatttt

SEQ ID NO: 19092 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatgg

SEQ ID NO: 19093 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatg

SEQ ID NO: 19094 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaat

SEQ ID NO: 19095 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaa

SEQ ID NO: 19096 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttcttta

SEQ ID NO: 19097 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttcttt

SEQ ID NO: 19098 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctt

SEQ ID NO: 19099 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttct

SEQ ID NO: 19100 - RNA, 116 nt, synthetic construct
  source 1..116: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 113: mod_base = OTHER; note = internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttc

SEQ ID NO: 19101 - RNA, 115 nt, synthetic construct
  source 1..115: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 112: mod_base = OTHER; note = internucleotide phosphorothioate linkage
  modified_base 113: mod_base = OTHER; note = 2'-O-methyl nucleotide with internucleotide phosphorothioate linkage
  modified_base 114: mod_base = OTHER; note = 2'-O-methyl nucleotide with internucleotide phosphorothioate linkage
  modified_base 115: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatatttt

SEQ ID NO: 19102 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatgg

SEQ ID NO: 19103 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatg

SEQ ID NO: 19104 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaat

SEQ ID NO: 19105 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaa

SEQ ID NO: 19106 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttcttta

SEQ ID NO: 19107 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttcttt

SEQ ID NO: 19108 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctt

SEQ ID NO: 19109 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttct

SEQ ID NO: 19110 - RNA, 118 nt, synthetic construct
  source 1..118: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 115: mod_base = OTHER; note = internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttc

SEQ ID NO: 19111 - RNA, 117 nt, synthetic construct
  source 1..117: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 114: mod_base = OTHER; note = internucleotide phosphorothioate linkage
  modified_base 115: mod_base = OTHER; note = 2'-O-methyl nucleotide with internucleotide phosphorothioate linkage
  modified_base 116: mod_base = OTHER; note = 2'-O-methyl nucleotide with internucleotide phosphorothioate linkage
  modified_base 117: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatatttt

SEQ ID NO: 19112 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatgg

SEQ ID NO: 19113 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatg

SEQ ID NO: 19114 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaat

SEQ ID NO: 19115 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaa

SEQ ID NO: 19116 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttcttta

SEQ ID NO: 19117 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttcttt

SEQ ID NO: 19118 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctt

SEQ ID NO: 19119 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttct

SEQ ID NO: 19120 - RNA, 120 nt, synthetic construct
  source 1..120: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 117: mod_base = OTHER; note = internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttc

SEQ ID NO: 19121 - RNA, 119 nt, synthetic construct
  source 1..119: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 116: mod_base = OTHER; note = internucleotide phosphorothioate linkage
  modified_base 117: mod_base = OTHER; note = 2'-O-methyl nucleotide with internucleotide phosphorothioate linkage
  modified_base 118: mod_base = OTHER; note = 2'-O-methyl nucleotide with internucleotide phosphorothioate linkage
  modified_base 119: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatatttt

SEQ ID NO: 19122 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatgg

SEQ ID NO: 19123 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatg

SEQ ID NO: 19124 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaat

SEQ ID NO: 19125 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaa

SEQ ID NO: 19126 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttcttta

SEQ ID NO: 19127 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttcttt

SEQ ID NO: 19128 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctt

SEQ ID NO: 19129 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttct

SEQ ID NO: 19130 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttc

SEQ ID NO: 19131 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatatttt

SEQ ID NO: 19132 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatgg

SEQ ID NO: 19133 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatg

SEQ ID NO: 19134 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaat

SEQ ID NO: 19135 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaa

SEQ ID NO: 19136 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttcttta

SEQ ID NO: 19137 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttcttt

SEQ ID NO: 19138 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctt

SEQ ID NO: 19139 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttct

SEQ ID NO: 19140 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttc

SEQ ID NO: 19141 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatatttt

SEQ ID NO: 19142 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatgg

SEQ ID NO: 19143 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatg

SEQ ID NO: 19144 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaat

SEQ ID NO: 19145 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaa

SEQ ID NO: 19146 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttcttta

SEQ ID NO: 19147 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttcttt

SEQ ID NO: 19148 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctt

SEQ ID NO: 19149 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttct

SEQ ID NO: 19150 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttc

SEQ ID NO: 19151 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatatttt

SEQ ID NO: 19152 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatgg

SEQ ID NO: 19153 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatg

SEQ ID NO: 19154 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaat

SEQ ID NO: 19155 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaa

SEQ ID NO: 19156 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttcttta

SEQ ID NO: 19157 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttcttt

SEQ ID NO: 19158 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctt

SEQ ID NO: 19159 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttct

SEQ ID NO: 19160 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttc

SEQ ID NO: 19161 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatatttt

SEQ ID NO: 19162 - RNA, 138 nt, synthetic construct
  source 1..138: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 135: mod_base = OTHER; note = internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatgg

SEQ ID NO: 19163 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatg

SEQ ID NO: 19164 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaat

SEQ ID NO: 19165 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaa

SEQ ID NO: 19166 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttcttta

SEQ ID NO: 19167 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttcttt

SEQ ID NO: 19168 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctt

SEQ ID NO: 19169 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttct

SEQ ID NO: 19170 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttc

SEQ ID NO: 19171 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatatttt

SEQ ID NO: 19172 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatggt

SEQ ID NO: 19173 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatggtg

SEQ ID NO: 19174 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatggtgc

SEQ ID NO: 19175 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcccaaagatgatattttctttaatggtgcc

SEQ ID NO: 19176 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatggt

SEQ ID NO: 19177 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatggtg

SEQ ID NO: 19178 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatggtgc

SEQ ID NO: 19179 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccaccaaagatgatattttctttaatggtgcc

SEQ ID NO: 19180 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatggt

SEQ ID NO: 19181 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatggtg

SEQ ID NO: 19182 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatggtgc

SEQ ID NO: 19183 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaacaccaaagatgatattttctttaatggtgcc

SEQ ID NO: 19184 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatggt

SEQ ID NO: 19185 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatggtg

SEQ ID NO: 19186 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatggtgc

SEQ ID NO: 19187 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcgaaacaccaaagatgatattttctttaatggtgcc

SEQ ID NO: 19188 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatggt

SEQ ID NO: 19189 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatggtg

SEQ ID NO: 19190 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatggtgc

SEQ ID NO: 19191 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaggaaacaccaaagatgatattttctttaatggtgcc

SEQ ID NO: 19192 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatggt

SEQ ID NO: 19193 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatggtg

SEQ ID NO: 19194 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatggtgc

SEQ ID NO: 19195 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcataggaaacaccaaagatgatattttctttaatggtgcc

SEQ ID NO: 19196 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatggt

SEQ ID NO: 19197 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatggtg

SEQ ID NO: 19198 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatggtgc

SEQ ID NO: 19199 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcataggaaacaccaaagatgatattttctttaatggtgcc

SEQ ID NO: 19200 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatggt

SEQ ID NO: 19201 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatggtg

SEQ ID NO: 19202 - RNA, 138 nt, synthetic construct
  source 1..138: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 135: mod_base = OTHER; note = internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatggtgc

SEQ ID NO: 19203 - RNA, 139 nt, synthetic construct
  source 1..139: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 136: mod_base = OTHER; note = internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccatcataggaaacaccaaagatgatattttctttaatggtgcc

SEQ ID NO: 19204 - RNA, 138 nt, synthetic construct
  source 1..138: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 135: mod_base = OTHER; note = internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatggt

SEQ ID NO: 19205 - RNA, 139 nt, synthetic construct
  source 1..139: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 136: mod_base = OTHER; note = internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatggtg

SEQ ID NO: 19206 - RNA, 140 nt, synthetic construct
  source 1..140: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 137: mod_base = OTHER; note = internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide with internucleotide phosphorothioate linkage
  modified_base 140: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatggtgc

SEQ ID NO: 19207 - RNA, 141 nt, synthetic construct
  source 1..141: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 138: mod_base = OTHER; note = internucleotide phosphorothioate linkage
  modified_base 139: mod_base = OTHER; note = 2'-O-methyl nucleotide with internucleotide phosphorothioate linkage
  modified_base 140: mod_base = OTHER; note = 2'-O-methyl nucleotide with internucleotide phosphorothioate linkage
  modified_base 141: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcttcatcataggaaacaccaaagatgatattttctttaatggtgcc

SEQ ID NO: 19208 - RNA, 123 nt, synthetic construct
  source 1..123: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 120: mod_base = OTHER; note = internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatggt

SEQ ID NO: 19209 - RNA, 124 nt, synthetic construct
  source 1..124: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 121: mod_base = OTHER; note = internucleotide phosphorothioate linkage
  modified_base 122: mod_base = OTHER; note = 2'-O-methyl nucleotide with internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatggtg

SEQ ID NO: 19210 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatggtgc

SEQ ID NO: 19211 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaccgaagatgatattttctttaatggtgcc

SEQ ID NO: 19212 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatggt

SEQ ID NO: 19213 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatggtg

SEQ ID NO: 19214 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatggtgc

SEQ ID NO: 19215 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcacaccgaagatgatattttctttaatggtgcc

SEQ ID NO: 19216 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatggt

SEQ ID NO: 19217 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatggtg

SEQ ID NO: 19218 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatggtgc

SEQ ID NO: 19219 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcaaacaccgaagatgatattttctttaatggtgcc

SEQ ID NO: 19220 - RNA, 129 nt, synthetic construct
  source 1..129: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 126: mod_base = OTHER; note = internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatggt

SEQ ID NO: 19221 - RNA, 130 nt, synthetic construct
  source 1..130: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 127: mod_base = OTHER; note = internucleotide phosphorothioate linkage
  modified_base 128: mod_base = OTHER; note = 2'-O-methyl nucleotide with internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatggtg

SEQ ID NO: 19222 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatggtgc

SEQ ID NO: 19223 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcggaaacaccgaagatgatattttctttaatggtgcc

SEQ ID NO: 19224 - RNA, 131 nt, synthetic construct
  source 1..131: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 128: mod_base = OTHER; note = internucleotide phosphorothioate linkage
  modified_base 129: mod_base = OTHER; note = 2'-O-methyl nucleotide with internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatggt

SEQ ID NO: 19225 - RNA, 132 nt, synthetic construct
  source 1..132: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 129: mod_base = OTHER; note = internucleotide phosphorothioate linkage
  modified_base 130: mod_base = OTHER; note = 2'-O-methyl nucleotide with internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatggtg

SEQ ID NO: 19226 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatggtgc

SEQ ID NO: 19227 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctaggaaacaccgaagatgatattttctttaatggtgcc

SEQ ID NO: 19228 - RNA, 133 nt, synthetic construct
  source 1..133: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 130: mod_base = OTHER; note = internucleotide phosphorothioate linkage
  modified_base 131: mod_base = OTHER; note = 2'-O-methyl nucleotide with internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatggt

SEQ ID NO: 19229 - RNA, 134 nt, synthetic construct
  source 1..134: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 131: mod_base = OTHER; note = internucleotide phosphorothioate linkage
  modified_base 132: mod_base = OTHER; note = 2'-O-methyl nucleotide with internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatggtg

SEQ ID NO: 19230 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatggtgc

SEQ ID NO: 19231 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgccataggaaacaccgaagatgatattttctttaatggtgcc

SEQ ID NO: 19232 - RNA, 135 nt, synthetic construct
  source 1..135: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 132: mod_base = OTHER; note = internucleotide phosphorothioate linkage
  modified_base 133: mod_base = OTHER; note = 2'-O-methyl nucleotide with internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatggt

SEQ ID NO: 19233 - RNA, 136 nt, synthetic construct
  source 1..136: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 133: mod_base = OTHER; note = internucleotide phosphorothioate linkage
  modified_base 134: mod_base = OTHER; note = 2'-O-methyl nucleotide with internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatggtg

SEQ ID NO: 19234 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatggtgc

SEQ ID NO: 19235 - RNA, 138 nt, synthetic construct
  source 1..138: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 135: mod_base = OTHER; note = internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcatcataggaaacaccgaagatgatattttctttaatggtgcc

SEQ ID NO: 19236 - RNA, 137 nt, synthetic construct
  source 1..137: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 134: mod_base = OTHER; note = internucleotide phosphorothioate linkage
  modified_base 135: mod_base = OTHER; note = 2'-O-methyl nucleotide with internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatggt

SEQ ID NO: 19237 - RNA, 138 nt, synthetic construct
  source 1..138: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 135: mod_base = OTHER; note = internucleotide phosphorothioate linkage
  modified_base 136: mod_base = OTHER; note = 2'-O-methyl nucleotide with internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatggtg

SEQ ID NO: 19238 - RNA, 139 nt, synthetic construct
  source 1..139: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 136: mod_base = OTHER; note = internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatggtgc

SEQ ID NO: 19239 - RNA, 140 nt, synthetic construct
  source 1..140: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 137: mod_base = OTHER; note = internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide with internucleotide phosphorothioate linkage
  modified_base 140: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgctcatcataggaaacaccgaagatgatattttctttaatggtgcc

SEQ ID NO: 19240 - RNA, 139 nt, synthetic construct
  source 1..139: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 136: mod_base = OTHER; note = internucleotide phosphorothioate linkage
  modified_base 137: mod_base = OTHER; note = 2'-O-methyl nucleotide with internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatggt

SEQ ID NO: 19241 - RNA, 140 nt, synthetic construct
  source 1..140: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 137: mod_base = OTHER; note = internucleotide phosphorothioate linkage
  modified_base 138: mod_base = OTHER; note = 2'-O-methyl nucleotide with internucleotide phosphorothioate linkage
  modified_base 139: mod_base = OTHER; note = 2'-O-methyl nucleotide with internucleotide phosphorothioate linkage
  modified_base 140: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatggtg

SEQ ID NO: 19242 - RNA, 141 nt, synthetic construct
  source 1..141: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 138: mod_base = OTHER; note = internucleotide phosphorothioate linkage
  modified_base 139: mod_base = OTHER; note = 2'-O-methyl nucleotide with internucleotide phosphorothioate linkage
  modified_base 140: mod_base = OTHER; note = 2'-O-methyl nucleotide with internucleotide phosphorothioate linkage
  modified_base 141: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatggtgc

SEQ ID NO: 19243 - RNA, 142 nt, synthetic construct
  source 1..142: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 139: mod_base = OTHER; note = internucleotide phosphorothioate linkage
  modified_base 140: mod_base = OTHER; note = 2'-O-methyl nucleotide with internucleotide phosphorothioate linkage
  modified_base 141: mod_base = OTHER; note = 2'-O-methyl nucleotide with internucleotide phosphorothioate linkage
  modified_base 142: mod_base = OTHER; note = 2'-O-methyl nucleotide
accattaaagaaaatatcatgttttagagctagaaatagcaagttaaaataaggctagtccgttatcaacttgaaaaagtggcaccgagtcggtgcattcatcataggaaacaccgaagatgatattttctttaatggtgcc

SEQ ID NO: 19244 - RNA, 119 nt, synthetic construct; identical to SEQ ID NO: 18945
  source 1..119: mol_type = other RNA

SEQ ID NO: 19245 - RNA, 99 nt, synthetic construct; identical to SEQ ID NO: 18946
  source 1..99: mol_type = other RNA

SEQ ID NO: 19246 - RNA, 99 nt, synthetic construct; identical to SEQ ID NO: 18947
  source 1..99: mol_type = other RNA

SEQ ID NO: 19247 - RNA, 97 nt, synthetic construct; identical to SEQ ID NO: 18948
  source 1..97: mol_type = other RNA

SEQ ID NO: 19248 - RNA, 97 nt, synthetic construct; identical to SEQ ID NO: 18949
  source 1..97: mol_type = other RNA

SEQ ID NO: 19249 - RNA, 97 nt, synthetic construct; identical to SEQ ID NO: 18950
  source 1..97: mol_type = other RNA

SEQ ID NO: 19250 - RNA, 97 nt, synthetic construct; identical to SEQ ID NO: 18951
  source 1..97: mol_type = other RNA

SEQ ID NO: 19251 - RNA, 97 nt, synthetic construct; identical to SEQ ID NO: 18952
  source 1..97: mol_type = other RNA

SEQ ID NO: 19252 - RNA, 97 nt, synthetic construct; identical to SEQ ID NO: 18953
  source 1..97: mol_type = other RNA

SEQ ID NO: 19253 - RNA, 97 nt, synthetic construct; identical to SEQ ID NO: 18954
  source 1..97: mol_type = other RNA

SEQ ID NO: 19254 - RNA, 97 nt, synthetic construct; identical to SEQ ID NO: 18955
  source 1..97: mol_type = other RNA

SEQ ID NO: 19255 - RNA, 97 nt, synthetic construct; identical to SEQ ID NO: 18956
  source 1..97: mol_type = other RNA

SEQ ID NO: 19256 - RNA, 97 nt, synthetic construct; identical to SEQ ID NO: 18957
  source 1..97: mol_type = other RNA

SEQ ID NO: 19257 - RNA, 96 nt, synthetic construct; identical to SEQ ID NO: 18958
  source 1..96: mol_type = other RNA

SEQ ID NO: 19258 - RNA, 96 nt, synthetic construct; identical to SEQ ID NO: 18959
  source 1..96: mol_type = other RNA

SEQ ID NO: 19259 - RNA, 96 nt, synthetic construct; identical to SEQ ID NO: 18960
  source 1..96: mol_type = other RNA

SEQ ID NO: 19260 - RNA, 96 nt, synthetic construct; identical to SEQ ID NO: 18961
  source 1..96: mol_type = other RNA

SEQ ID NO: 19261 - RNA, 96 nt, synthetic construct; identical to SEQ ID NO: 18962
  source 1..96: mol_type = other RNA

SEQ ID NO: 19262 - RNA, 96 nt, synthetic construct; identical to SEQ ID NO: 18963
  source 1..96: mol_type = other RNA

SEQ ID NO: 19263 - RNA, 96 nt, synthetic construct; identical to SEQ ID NO: 18964
  source 1..96: mol_type = other RNA

SEQ ID NO: 19264 - RNA, 96 nt, synthetic construct; identical to SEQ ID NO: 18965
  source 1..96: mol_type = other RNA

SEQ ID NO: 19265 - RNA, 96 nt, synthetic construct; identical to SEQ ID NO: 18966
  source 1..96: mol_type = other RNA

SEQ ID NO: 19266 - RNA, 96 nt, synthetic construct; identical to SEQ ID NO: 18967
  source 1..96: mol_type = other RNA

SEQ ID NO: 19267 - RNA, 96 nt, synthetic construct; identical to SEQ ID NO: 18968
  source 1..96: mol_type = other RNA

SEQ ID NO: 19268 - RNA, 96 nt, synthetic construct; identical to SEQ ID NO: 18969
  source 1..96: mol_type = other RNA

SEQ ID NO: 19269 - RNA, 96 nt, synthetic construct; identical to SEQ ID NO: 18970
  source 1..96: mol_type = other RNA

SEQ ID NO: 19270 - RNA, 96 nt, synthetic construct; identical to SEQ ID NO: 18971
  source 1..96: mol_type = other RNA

SEQ ID NO: 19271 - RNA, 96 nt, synthetic construct; identical to SEQ ID NO: 18972
  source 1..96: mol_type = other RNA

SEQ ID NO: 19272 - RNA, 96 nt, synthetic construct; identical to SEQ ID NO: 18973
  source 1..96: mol_type = other RNA

SEQ ID NO: 19273 - RNA, 96 nt, synthetic construct; identical to SEQ ID NO: 18974
  source 1..96: mol_type = other RNA

SEQ ID NO: 19274 - RNA, 96 nt, synthetic construct; identical to SEQ ID NO: 18975
  source 1..96: mol_type = other RNA

SEQ ID NO: 19275 - RNA, 96 nt, synthetic construct; identical to SEQ ID NO: 18976
  source 1..96: mol_type = other RNA

SEQ ID NO: 19276 - RNA, 96 nt, synthetic construct; identical to SEQ ID NO: 18977
  source 1..96: mol_type = other RNA

SEQ ID NO: 19277 - RNA, 96 nt, synthetic construct; identical to SEQ ID NO: 18978
  source 1..96: mol_type = other RNA

SEQ ID NO: 19278 - RNA, 96 nt, synthetic construct; identical to SEQ ID NO: 18979
  source 1..96: mol_type = other RNA

SEQ ID NO: 19279 - RNA, 96 nt, synthetic construct; identical to SEQ ID NO: 18980
  source 1..96: mol_type = other RNA

SEQ ID NO: 19280 - RNA, 96 nt, synthetic construct; identical to SEQ ID NO: 18981
  source 1..96: mol_type = other RNA

SEQ ID NO: 19281 - RNA, 96 nt, synthetic construct; identical to SEQ ID NO: 18982
  source 1..96: mol_type = other RNA

SEQ ID NO: 19282 - RNA, 96 nt, synthetic construct; identical to SEQ ID NO: 18983
  source 1..96: mol_type = other RNA

SEQ ID NO: 19283 - RNA, 96 nt, synthetic construct; identical to SEQ ID NO: 18984
  source 1..96: mol_type = other RNA

SEQ ID NO: 19284 - RNA, 96 nt, synthetic construct; identical to SEQ ID NO: 18985
  source 1..96: mol_type = other RNA

SEQ ID NO: 19285 - RNA, 96 nt, synthetic construct; identical to SEQ ID NO: 18986
  source 1..96: mol_type = other RNA

SEQ ID NO: 19286 - RNA, 96 nt, synthetic construct; identical to SEQ ID NO: 18987
  source 1..96: mol_type = other RNA

SEQ ID NO: 19287 - RNA, 96 nt, synthetic construct; identical to SEQ ID NO: 18988
  source 1..96: mol_type = other RNA

SEQ ID NO: 19288 - RNA, 96 nt, synthetic construct; identical to SEQ ID NO: 18989
  source 1..96: mol_type = other RNA

SEQ ID NO: 19289 - RNA, 104 nt, synthetic construct; identical to SEQ ID NO: 18990
  source 1..104: mol_type = other RNA

SEQ ID NO: 19290 - RNA, 104 nt, synthetic construct; identical to SEQ ID NO: 18991
  source 1..104: mol_type = other RNA

SEQ ID NO: 19291 - RNA, 121 nt, synthetic construct; identical to SEQ ID NO: 18992
  source 1..121: mol_type = other RNA

SEQ ID NO: 19292 - RNA, 120 nt, synthetic construct; identical to SEQ ID NO: 18993
  source 1..120: mol_type = other RNA

SEQ ID NO: 19293 - RNA, 119 nt, synthetic construct; identical to SEQ ID NO: 18994
  source 1..119: mol_type = other RNA

SEQ ID NO: 19294 - RNA, 118 nt, synthetic construct; identical to SEQ ID NO: 18995
  source 1..118: mol_type = other RNA

SEQ ID NO: 19295 - RNA, 117 nt, synthetic construct; identical to SEQ ID NO: 18996
  source 1..117: mol_type = other RNA

SEQ ID NO: 19296 - RNA, 116 nt, synthetic construct; identical to SEQ ID NO: 18997
  source 1..116: mol_type = other RNA

SEQ ID NO: 19297 - RNA, 115 nt, synthetic construct; identical to SEQ ID NO: 18998
  source 1..115: mol_type = other RNA

SEQ ID NO: 19298 - RNA, 114 nt, synthetic construct; identical to SEQ ID NO: 18999
  source 1..114: mol_type = other RNA

SEQ ID NO: 19299 - RNA, 113 nt, synthetic construct; identical to SEQ ID NO: 19000
  source 1..113: mol_type = other RNA

SEQ ID NO: 19300 - RNA, 112 nt, synthetic construct; identical to SEQ ID NO: 19001
  source 1..112: mol_type = other RNA

SEQ ID NO: 19301 - RNA, 123 nt, synthetic construct; identical to SEQ ID NO: 19002
  source 1..123: mol_type = other RNA

SEQ ID NO: 19302 - RNA, 122 nt, synthetic construct; identical to SEQ ID NO: 19003
  source 1..122: mol_type = other RNA

SEQ ID NO: 19303 - RNA, 121 nt, synthetic construct; identical to SEQ ID NO: 19004
  source 1..121: mol_type = other RNA

SEQ ID NO: 19304 - RNA, 120 nt, synthetic construct; identical to SEQ ID NO: 19005
  source 1..120: mol_type = other RNA

SEQ ID NO: 19305 - RNA, 119 nt, synthetic construct; identical to SEQ ID NO: 19006
  source 1..119: mol_type = other RNA

SEQ ID NO: 19306 - RNA, 118 nt, synthetic construct; identical to SEQ ID NO: 19007
  source 1..118: mol_type = other RNA

SEQ ID NO: 19307 - RNA, 117 nt, synthetic construct; identical to SEQ ID NO: 19008
  source 1..117: mol_type = other RNA

SEQ ID NO: 19308 - RNA, 116 nt, synthetic construct; identical to SEQ ID NO: 19009
  source 1..116: mol_type = other RNA

SEQ ID NO: 19309 - RNA, 115 nt, synthetic construct; identical to SEQ ID NO: 19010
  source 1..115: mol_type = other RNA

SEQ ID NO: 19310 - RNA, 114 nt, synthetic construct; identical to SEQ ID NO: 19011
  source 1..114: mol_type = other RNA

SEQ ID NO: 19311 - RNA, 125 nt, synthetic construct; identical to SEQ ID NO: 19012
  source 1..125: mol_type = other RNA

SEQ ID NO: 19312 - RNA, 124 nt, synthetic construct; identical to SEQ ID NO: 19013
  source 1..124: mol_type = other RNA

SEQ ID NO: 19313 - RNA, 123 nt, synthetic construct; identical to SEQ ID NO: 19014
  source 1..123: mol_type = other RNA

SEQ ID NO: 19314 - RNA, 122 nt, synthetic construct; identical to SEQ ID NO: 19015
  source 1..122: mol_type = other RNA

SEQ ID NO: 19315 - RNA, 121 nt, synthetic construct; identical to SEQ ID NO: 19016
  source 1..121: mol_type = other RNA

SEQ ID NO: 19316 - RNA, 120 nt, synthetic construct; identical to SEQ ID NO: 19017
  source 1..120: mol_type = other RNA

SEQ ID NO: 19317 - RNA, 119 nt, synthetic construct; identical to SEQ ID NO: 19018
  source 1..119: mol_type = other RNA

SEQ ID NO: 19318 - RNA, 118 nt, synthetic construct; identical to SEQ ID NO: 19019
  source 1..118: mol_type = other RNA

SEQ ID NO: 19319 - RNA, 117 nt, synthetic construct; identical to SEQ ID NO: 19020
  source 1..117: mol_type = other RNA

SEQ ID NO: 19320 - RNA, 116 nt, synthetic construct; identical to SEQ ID NO: 19021
  source 1..116: mol_type = other RNA

SEQ ID NO: 19321 - RNA, 127 nt, synthetic construct; identical to SEQ ID NO: 19022
  source 1..127: mol_type = other RNA

SEQ ID NO: 19322 - RNA, 126 nt, synthetic construct; identical to SEQ ID NO: 19023
  source 1..126: mol_type = other RNA

SEQ ID NO: 19323 - RNA, 125 nt, synthetic construct; identical to SEQ ID NO: 19024
  source 1..125: mol_type = other RNA

SEQ ID NO: 19324 - RNA, 124 nt, synthetic construct; identical to SEQ ID NO: 19025
  source 1..124: mol_type = other RNA

SEQ ID NO: 19325 - RNA, 123 nt, synthetic construct; identical to SEQ ID NO: 19026
  source 1..123: mol_type = other RNA

SEQ ID NO: 19326 - RNA, 122 nt, synthetic construct; identical to SEQ ID NO: 19027
  source 1..122: mol_type = other RNA

SEQ ID NO: 19327 - RNA, 121 nt, synthetic construct; identical to SEQ ID NO: 19028
  source 1..121: mol_type = other RNA

SEQ ID NO: 19328 - RNA, 120 nt, synthetic construct; identical to SEQ ID NO: 19029
  source 1..120: mol_type = other RNA

SEQ ID NO: 19329 - RNA, 119 nt, synthetic construct; identical to SEQ ID NO: 19030
  source 1..119: mol_type = other RNA

SEQ ID NO: 19330 - RNA, 118 nt, synthetic construct; identical to SEQ ID NO: 19031
  source 1..118: mol_type = other RNA

SEQ ID NO: 19331 - RNA, 129 nt, synthetic construct; identical to SEQ ID NO: 19032
  source 1..129: mol_type = other RNA

SEQ ID NO: 19332 - RNA, 128 nt, synthetic construct; identical to SEQ ID NO: 19033
  source 1..128: mol_type = other RNA

SEQ ID NO: 19333 - RNA, 127 nt, synthetic construct; identical to SEQ ID NO: 19034
  source 1..127: mol_type = other RNA

SEQ ID NO: 19334 - RNA, 126 nt, synthetic construct; identical to SEQ ID NO: 19035
  source 1..126: mol_type = other RNA

SEQ ID NO: 19335 - RNA, 125 nt, synthetic construct; identical to SEQ ID NO: 19036
  source 1..125: mol_type = other RNA

SEQ ID NO: 19336 - RNA, 124 nt, synthetic construct; identical to SEQ ID NO: 19037
  source 1..124: mol_type = other RNA

SEQ ID NO: 19337 - RNA, 123 nt, synthetic construct; identical to SEQ ID NO: 19038
  source 1..123: mol_type = other RNA

SEQ ID NO: 19338 - RNA, 122 nt, synthetic construct; identical to SEQ ID NO: 19039
  source 1..122: mol_type = other RNA

SEQ ID NO: 19339 - RNA, 121 nt, synthetic construct; identical to SEQ ID NO: 19040
  source 1..121: mol_type = other RNA

SEQ ID NO: 19340 - RNA, 120 nt, synthetic construct; identical to SEQ ID NO: 19041
  source 1..120: mol_type = other RNA

SEQ ID NO: 19341 - RNA, 131 nt, synthetic construct; identical to SEQ ID NO: 19042
  source 1..131: mol_type = other RNA

SEQ ID NO: 19342 - RNA, 130 nt, synthetic construct; identical to SEQ ID NO: 19043
  source 1..130: mol_type = other RNA

SEQ ID NO: 19343 - RNA, 129 nt, synthetic construct; identical to SEQ ID NO: 19044
  source 1..129: mol_type = other RNA

SEQ ID NO: 19344 - RNA, 128 nt, synthetic construct; identical to SEQ ID NO: 19045
  source 1..128: mol_type = other RNA

SEQ ID NO: 19345 - RNA, 127 nt, synthetic construct; identical to SEQ ID NO: 19046
  source 1..127: mol_type = other RNA

SEQ ID NO: 19346 - RNA, 126 nt, synthetic construct; identical to SEQ ID NO: 19047
  source 1..126: mol_type = other RNA

SEQ ID NO: 19347 - RNA, 125 nt, synthetic construct; identical to SEQ ID NO: 19048
  source 1..125: mol_type = other RNA

SEQ ID NO: 19348 - RNA, 124 nt, synthetic construct; identical to SEQ ID NO: 19049
  source 1..124: mol_type = other RNA

SEQ ID NO: 19349 - RNA, 123 nt, synthetic construct; identical to SEQ ID NO: 19050
  source 1..123: mol_type = other RNA

SEQ ID NO: 19350 - RNA, 122 nt, synthetic construct; identical to SEQ ID NO: 19051
  source 1..122: mol_type = other RNA

SEQ ID NO: 19351 - RNA, 133 nt, synthetic construct; identical to SEQ ID NO: 19052
  source 1..133: mol_type = other RNA

SEQ ID NO: 19352 - RNA, 132 nt, synthetic construct; identical to SEQ ID NO: 19053
  source 1..132: mol_type = other RNA

SEQ ID NO: 19353 - RNA, 131 nt, synthetic construct; identical to SEQ ID NO: 19054
  source 1..131: mol_type = other RNA

SEQ ID NO: 19354 - RNA, 130 nt, synthetic construct; identical to SEQ ID NO: 19055
  source 1..130: mol_type = other RNA

SEQ ID NO: 19355 - RNA, 129 nt, synthetic construct; identical to SEQ ID NO: 19056
  source 1..129: mol_type = other RNA

SEQ ID NO: 19356 - RNA, 128 nt, synthetic construct; identical to SEQ ID NO: 19057
  source 1..128: mol_type = other RNA

SEQ ID NO: 19357 - RNA, 127 nt, synthetic construct; identical to SEQ ID NO: 19058
  source 1..127: mol_type = other RNA

SEQ ID NO: 19358 - RNA, 126 nt, synthetic construct; identical to SEQ ID NO: 19059
  source 1..126: mol_type = other RNA

SEQ ID NO: 19359 - RNA, 125 nt, synthetic construct; identical to SEQ ID NO: 19060
  source 1..125: mol_type = other RNA

SEQ ID NO: 19360 - RNA, 124 nt, synthetic construct; identical to SEQ ID NO: 19061
  source 1..124: mol_type = other RNA

SEQ ID NO: 19361 - RNA, 135 nt, synthetic construct; identical to SEQ ID NO: 19062
  source 1..135: mol_type = other RNA

SEQ ID NO: 19362 - RNA, 134 nt, synthetic construct; identical to SEQ ID NO: 19063
  source 1..134: mol_type = other RNA

SEQ ID NO: 19363 - RNA, 133 nt, synthetic construct; identical to SEQ ID NO: 19064
  source 1..133: mol_type = other RNA

SEQ ID NO: 19364 - RNA, 132 nt, synthetic construct; identical to SEQ ID NO: 19065
  source 1..132: mol_type = other RNA

SEQ ID NO: 19365 - RNA, 131 nt, synthetic construct; identical to SEQ ID NO: 19066
  source 1..131: mol_type = other RNA

SEQ ID NO: 19366 - RNA, 130 nt, synthetic construct; identical to SEQ ID NO: 19067
  source 1..130: mol_type = other RNA

SEQ ID NO: 19367 - RNA, 129 nt, synthetic construct; identical to SEQ ID NO: 19068
  source 1..129: mol_type = other RNA

SEQ ID NO: 19368 - RNA, 128 nt, synthetic construct; identical to SEQ ID NO: 19069
  source 1..128: mol_type = other RNA

SEQ ID NO: 19369 - RNA, 127 nt, synthetic construct; identical to SEQ ID NO: 19070
  source 1..127: mol_type = other RNA

SEQ ID NO: 19370 - RNA, 126 nt, synthetic construct; identical to SEQ ID NO: 19071
  source 1..126: mol_type = other RNA

SEQ ID NO: 19371 - RNA, 137 nt, synthetic construct; identical to SEQ ID NO: 19072
  source 1..137: mol_type = other RNA

SEQ ID NO: 19372 - RNA, 136 nt, synthetic construct; identical to SEQ ID NO: 19073
  source 1..136: mol_type = other RNA

SEQ ID NO: 19373 - RNA, 135 nt, synthetic construct; identical to SEQ ID NO: 19074
  source 1..135: mol_type = other RNA

SEQ ID NO: 19374 - RNA, 134 nt, synthetic construct; identical to SEQ ID NO: 19075
  source 1..134: mol_type = other RNA

SEQ ID NO: 19375 - RNA, 133 nt, synthetic construct; identical to SEQ ID NO: 19076
  source 1..133: mol_type = other RNA

SEQ ID NO: 19376 - RNA, 132 nt, synthetic construct; identical to SEQ ID NO: 19077
  source 1..132: mol_type = other RNA

SEQ ID NO: 19377 - RNA, 131 nt, synthetic construct; identical to SEQ ID NO: 19078
  source 1..131: mol_type = other RNA

SEQ ID NO: 19378 - RNA, 130 nt, synthetic construct; identical to SEQ ID NO: 19079
  source 1..130: mol_type = other RNA

SEQ ID NO: 19379 - RNA, 129 nt, synthetic construct; identical to SEQ ID NO: 19080
  source 1..129: mol_type = other RNA

SEQ ID NO: 19380 - RNA, 128 nt, synthetic construct; identical to SEQ ID NO: 19081
  source 1..128: mol_type = other RNA

SEQ ID NO: 19381 - RNA, 122 nt, synthetic construct; identical to SEQ ID NO: 19082
  source 1..122: mol_type = other RNA

SEQ ID NO: 19382 - RNA, 121 nt, synthetic construct; identical to SEQ ID NO: 19083
  source 1..121: mol_type = other RNA

SEQ ID NO: 19383 - RNA, 120 nt, synthetic construct; identical to SEQ ID NO: 19084
  source 1..120: mol_type = other RNA

SEQ ID NO: 19384 - RNA, 119 nt, synthetic construct; identical to SEQ ID NO: 19085
  source 1..119: mol_type = other RNA

SEQ ID NO: 19385 - RNA, 118 nt, synthetic construct; identical to SEQ ID NO: 19086
  source 1..118: mol_type = other RNA

SEQ ID NO: 19386 - RNA, 117 nt, synthetic construct; identical to SEQ ID NO: 19087
  source 1..117: mol_type = other RNA

SEQ ID NO: 19387 - RNA, 116 nt, synthetic construct; identical to SEQ ID NO: 19088
  source 1..116: mol_type = other RNA

SEQ ID NO: 19388 - RNA, 115 nt, synthetic construct; identical to SEQ ID NO: 19089
  source 1..115: mol_type = other RNA

SEQ ID NO: 19389 - RNA, 114 nt, synthetic construct; identical to SEQ ID NO: 19090
  source 1..114: mol_type = other RNA

SEQ ID NO: 19390 - RNA, 113 nt, synthetic construct; identical to SEQ ID NO: 19091
  source 1..113: mol_type = other RNA

SEQ ID NO: 19391 - RNA, 124 nt, synthetic construct; identical to SEQ ID NO: 19092
  source 1..124: mol_type = other RNA

SEQ ID NO: 19392 - RNA, 123 nt, synthetic construct; identical to SEQ ID NO: 19093
  source 1..123: mol_type = other RNA

SEQ ID NO: 19393 - RNA, 122 nt, synthetic construct; identical to SEQ ID NO: 19094
  source 1..122: mol_type = other RNA

SEQ ID NO: 19394 - RNA, 121 nt, synthetic construct; identical to SEQ ID NO: 19095
  source 1..121: mol_type = other RNA

SEQ ID NO: 19395 - RNA, 120 nt, synthetic construct; identical to SEQ ID NO: 19096
  source 1..120: mol_type = other RNA

SEQ ID NO: 19396 - RNA, 119 nt, synthetic construct; identical to SEQ ID NO: 19097
  source 1..119: mol_type = other RNA

SEQ ID NO: 19397 - RNA, 118 nt, synthetic construct; identical to SEQ ID NO: 19098
  source 1..118: mol_type = other RNA

SEQ ID NO: 19398 - RNA, 117 nt, synthetic construct; identical to SEQ ID NO: 19099
  source 1..117: mol_type = other RNA

SEQ ID NO: 19399 - RNA, 116 nt, synthetic construct; identical to SEQ ID NO: 19100
  source 1..116: mol_type = other RNA

SEQ ID NO: 19400 - RNA, 115 nt, synthetic construct; identical to SEQ ID NO: 19101
  source 1..115: mol_type = other RNA

SEQ ID NO: 19401 - RNA, 126 nt, synthetic construct; identical to SEQ ID NO: 19102
  source 1..126: mol_type = other RNA

SEQ ID NO: 19402 - RNA, 125 nt, synthetic construct; identical to SEQ ID NO: 19103
  source 1..125: mol_type = other RNA

SEQ ID NO: 19403 - RNA, 124 nt, synthetic construct; identical to SEQ ID NO: 19104
  source 1..124: mol_type = other RNA

SEQ ID NO: 19404 - RNA, 123 nt, synthetic construct; identical to SEQ ID NO: 19105
  source 1..123: mol_type = other RNA

SEQ ID NO: 19405 - RNA, 122 nt, synthetic construct; identical to SEQ ID NO: 19106
  source 1..122: mol_type = other RNA

SEQ ID NO: 19406 - RNA, 121 nt, synthetic construct; identical to SEQ ID NO: 19107
  source 1..121: mol_type = other RNA

SEQ ID NO: 19407 - RNA, 120 nt, synthetic construct; identical to SEQ ID NO: 19108
  source 1..120: mol_type = other RNA

SEQ ID NO: 19408 - RNA, 119 nt, synthetic construct; identical to SEQ ID NO: 19109
  source 1..119: mol_type = other RNA

SEQ ID NO: 19409 - RNA, 118 nt, synthetic construct; identical to SEQ ID NO: 19110
  source 1..118: mol_type = other RNA

SEQ ID NO: 19410 - RNA, 117 nt, synthetic construct; identical to SEQ ID NO: 19111
  source 1..117: mol_type = other RNA

SEQ ID NO: 19411 - RNA, 128 nt, synthetic construct; identical to SEQ ID NO: 19112
  source 1..128: mol_type = other RNA

SEQ ID NO: 19412 - RNA, 127 nt, synthetic construct; identical to SEQ ID NO: 19113
  source 1..127: mol_type = other RNA

SEQ ID NO: 19413 - RNA, 126 nt, synthetic construct; identical to SEQ ID NO: 19114
  source 1..126: mol_type = other RNA

SEQ ID NO: 19414 - RNA, 125 nt, synthetic construct; identical to SEQ ID NO: 19115
  source 1..125: mol_type = other RNA

SEQ ID NO: 19415 - RNA, 124 nt, synthetic construct; identical to SEQ ID NO: 19116
  source 1..124: mol_type = other RNA

SEQ ID NO: 19416 - RNA, 123 nt, synthetic construct; identical to SEQ ID NO: 19117
  source 1..123: mol_type = other RNA

SEQ ID NO: 19417 - RNA, 122 nt, synthetic construct; identical to SEQ ID NO: 19118
  source 1..122: mol_type = other RNA

SEQ ID NO: 19418 - RNA, 121 nt, synthetic construct; identical to SEQ ID NO: 19119
  source 1..121: mol_type = other RNA

SEQ ID NO: 19419 - RNA, 120 nt, synthetic construct; identical to SEQ ID NO: 19120
  source 1..120: mol_type = other RNA

SEQ ID NO: 19420 - RNA, 119 nt, synthetic construct; identical to SEQ ID NO: 19121
  source 1..119: mol_type = other RNA

SEQ ID NO: 19421 - RNA, 130 nt, synthetic construct; identical to SEQ ID NO: 19122
  source 1..130: mol_type = other RNA

SEQ ID NO: 19422 - RNA, 129 nt, synthetic construct; identical to SEQ ID NO: 19123
  source 1..129: mol_type = other RNA

SEQ ID NO: 19423 - RNA, 128 nt, synthetic construct; identical to SEQ ID NO: 19124
  source 1..128: mol_type = other RNA

SEQ ID NO: 19424 - RNA, 127 nt, synthetic construct; identical to SEQ ID NO: 19125
  source 1..127: mol_type = other RNA

SEQ ID NO: 19425 - RNA, 126 nt, synthetic construct; identical to SEQ ID NO: 19126
  source 1..126: mol_type = other RNA

SEQ ID NO: 19426 - RNA, 125 nt, synthetic construct; identical to SEQ ID NO: 19127
  source 1..125: mol_type = other RNA

SEQ ID NO: 19427 - RNA, 124 nt, synthetic construct; identical to SEQ ID NO: 19128
  source 1..124: mol_type = other RNA

SEQ ID NO: 19428 - RNA, 123 nt, synthetic construct; identical to SEQ ID NO: 19129
  source 1..123: mol_type = other RNA

SEQ ID NO: 19429 - RNA, 122 nt, synthetic construct; identical to SEQ ID NO: 19130
  source 1..122: mol_type = other RNA

SEQ ID NO: 19430 - RNA, 121 nt, synthetic construct; identical to SEQ ID NO: 19131
  source 1..121: mol_type = other RNA

SEQ ID NO: 19431 - RNA, 132 nt, synthetic construct; identical to SEQ ID NO: 19132
  source 1..132: mol_type = other RNA

SEQ ID NO: 19432 - RNA, 131 nt, synthetic construct; identical to SEQ ID NO: 19133
  source 1..131: mol_type = other RNA

SEQ ID NO: 19433 - RNA, 130 nt, synthetic construct; identical to SEQ ID NO: 19134
  source 1..130: mol_type = other RNA

SEQ ID NO: 19434 - RNA, 129 nt, synthetic construct; identical to SEQ ID NO: 19135
  source 1..129: mol_type = other RNA

SEQ ID NO: 19435 - RNA, 128 nt, synthetic construct; identical to SEQ ID NO: 19136
  source 1..128: mol_type = other RNA

SEQ ID NO: 19436 - RNA, 127 nt, synthetic construct; identical to SEQ ID NO: 19137
  source 1..127: mol_type = other RNA

SEQ ID NO: 19437 - RNA, 126 nt, synthetic construct; identical to SEQ ID NO: 19138
  source 1..126: mol_type = other RNA

SEQ ID NO: 19438 - RNA, 125 nt, synthetic construct; identical to SEQ ID NO: 19139
  source 1..125: mol_type = other RNA

SEQ ID NO: 19439 - RNA, 124 nt, synthetic construct; identical to SEQ ID NO: 19140
  source 1..124: mol_type = other RNA

SEQ ID NO: 19440 - RNA, 123 nt, synthetic construct; identical to SEQ ID NO: 19141
  source 1..123: mol_type = other RNA

SEQ ID NO: 19441 - RNA, 134 nt, synthetic construct; identical to SEQ ID NO: 19142
  source 1..134: mol_type = other RNA

SEQ ID NO: 19442 - RNA, 133 nt, synthetic construct; identical to SEQ ID NO: 19143
  source 1..133: mol_type = other RNA

SEQ ID NO: 19443 - RNA, 132 nt, synthetic construct; identical to SEQ ID NO: 19144
  source 1..132: mol_type = other RNA

SEQ ID NO: 19444 - RNA, 131 nt, synthetic construct; identical to SEQ ID NO: 19145
  source 1..131: mol_type = other RNA

SEQ ID NO: 19445 - RNA, 130 nt, synthetic construct; identical to SEQ ID NO: 19146
  source 1..130: mol_type = other RNA

SEQ ID NO: 19446 - RNA, 129 nt, synthetic construct; identical to SEQ ID NO: 19147
  source 1..129: mol_type = other RNA

SEQ ID NO: 19447 - RNA, 128 nt, synthetic construct; identical to SEQ ID NO: 19148
  source 1..128: mol_type = other RNA

SEQ ID NO: 19448 - RNA, 127 nt, synthetic construct; identical to SEQ ID NO: 19149
  source 1..127: mol_type = other RNA

SEQ ID NO: 19449 - RNA, 126 nt, synthetic construct; identical to SEQ ID NO: 19150
  source 1..126: mol_type = other RNA

SEQ ID NO: 19450 - RNA, 125 nt, synthetic construct; identical to SEQ ID NO: 19151
  source 1..125: mol_type = other RNA

SEQ ID NO: 19451 - RNA, 136 nt, synthetic construct; identical to SEQ ID NO: 19152
  source 1..136: mol_type = other RNA

SEQ ID NO: 19452 - RNA, 135 nt, synthetic construct; identical to SEQ ID NO: 19153
  source 1..135: mol_type = other RNA

SEQ ID NO: 19453 - RNA, 134 nt, synthetic construct; identical to SEQ ID NO: 19154
  source 1..134: mol_type = other RNA

SEQ ID NO: 19454 - RNA, 133 nt, synthetic construct; identical to SEQ ID NO: 19155
  source 1..133: mol_type = other RNA

SEQ ID NO: 19455 - RNA, 132 nt, synthetic construct; identical to SEQ ID NO: 19156
  source 1..132: mol_type = other RNA

SEQ ID NO: 19456 - RNA, 131 nt, synthetic construct; identical to SEQ ID NO: 19157
  source 1..131: mol_type = other RNA

SEQ ID NO: 19457 - RNA, 130 nt, synthetic construct; identical to SEQ ID NO: 19158
  source 1..130: mol_type = other RNA

SEQ ID NO: 19458 - RNA, 129 nt, synthetic construct; identical to SEQ ID NO: 19159
  source 1..129: mol_type = other RNA

SEQ ID NO: 19459 - RNA, 128 nt, synthetic construct; identical to SEQ ID NO: 19160
  source 1..128: mol_type = other RNA

SEQ ID NO: 19460 - RNA, 127 nt, synthetic construct; identical to SEQ ID NO: 19161
  source 1..127: mol_type = other RNA

SEQ ID NO: 19461 - RNA, 138 nt, synthetic construct; identical to SEQ ID NO: 19162
  source 1..138: mol_type = other RNA

SEQ ID NO: 19462 - RNA, 137 nt, synthetic construct; identical to SEQ ID NO: 19163
  source 1..137: mol_type = other RNA

SEQ ID NO: 19463 - RNA, 136 nt, synthetic construct; identical to SEQ ID NO: 19164
  source 1..136: mol_type = other RNA

SEQ ID NO: 19464 - RNA, 135 nt, synthetic construct; identical to SEQ ID NO: 19165
  source 1..135: mol_type = other RNA

SEQ ID NO: 19465 - RNA, 134 nt, synthetic construct; identical to SEQ ID NO: 19166
  source 1..134: mol_type = other RNA

SEQ ID NO: 19466 - RNA, 133 nt, synthetic construct; identical to SEQ ID NO: 19167
  source 1..133: mol_type = other RNA

SEQ ID NO: 19467 - RNA, 132 nt, synthetic construct; identical to SEQ ID NO: 19168
  source 1..132: mol_type = other RNA

SEQ ID NO: 19468 - RNA, 131 nt, synthetic construct; identical to SEQ ID NO: 19169
  source 1..131: mol_type = other RNA

SEQ ID NO: 19469 - RNA, 130 nt, synthetic construct; identical to SEQ ID NO: 19170
  source 1..130: mol_type = other RNA

SEQ ID NO: 19470 - RNA, 129 nt, synthetic construct; identical to SEQ ID NO: 19171
  source 1..129: mol_type = other RNA

SEQ ID NO: 19471 - RNA, 122 nt, synthetic construct; identical to SEQ ID NO: 19172
  source 1..122: mol_type = other RNA

SEQ ID NO: 19472 - RNA, 123 nt, synthetic construct; identical to SEQ ID NO: 19173
  source 1..123: mol_type = other RNA

SEQ ID NO: 19473 - RNA, 124 nt, synthetic construct; identical to SEQ ID NO: 19174
  source 1..124: mol_type = other RNA

SEQ ID NO: 19474 - RNA, 125 nt, synthetic construct; identical to SEQ ID NO: 19175
  source 1..125: mol_type = other RNA

SEQ ID NO: 19475 - RNA, 124 nt, synthetic construct; identical to SEQ ID NO: 19176
  source 1..124: mol_type = other RNA

SEQ ID NO: 19476 - RNA, 125 nt, synthetic construct; identical to SEQ ID NO: 19177
  source 1..125: mol_type = other RNA

SEQ ID NO: 19477 - RNA, 126 nt, synthetic construct; identical to SEQ ID NO: 19178
  source 1..126: mol_type = other RNA

SEQ ID NO: 19478 - RNA, 127 nt, synthetic construct; identical to SEQ ID NO: 19179
  source 1..127: mol_type = other RNA

SEQ ID NO: 19479 - RNA, 126 nt, synthetic construct; identical to SEQ ID NO: 19180
  source 1..126: mol_type = other RNA

SEQ ID NO: 19480 - RNA, 127 nt, synthetic construct; identical to SEQ ID NO: 19181
  source 1..127: mol_type = other RNA

SEQ ID NO: 19481 - RNA, 128 nt, synthetic construct; identical to SEQ ID NO: 19182
  source 1..128: mol_type = other RNA

SEQ ID NO: 19482 - RNA, 129 nt, synthetic construct; identical to SEQ ID NO: 19183
  source 1..129: mol_type = other RNA

SEQ ID NO: 19483 - RNA, 128 nt, synthetic construct; identical to SEQ ID NO: 19184
  source 1..128: mol_type = other RNA

SEQ ID NO: 19484 - RNA, 129 nt, synthetic construct; identical to SEQ ID NO: 19185
  source 1..129: mol_type = other RNA

SEQ ID NO: 19485 - RNA, 130 nt, synthetic construct; identical to SEQ ID NO: 19186
  source 1..130: mol_type = other RNA

SEQ ID NO: 19486 - RNA, 131 nt, synthetic construct; identical to SEQ ID NO: 19187
  source 1..131: mol_type = other RNA

SEQ ID NO: 19487 - RNA, 130 nt, synthetic construct; identical to SEQ ID NO: 19188
  source 1..130: mol_type = other RNA

SEQ ID NO: 19488 - RNA, 131 nt, synthetic construct; identical to SEQ ID NO: 19189
  source 1..131: mol_type = other RNA

SEQ ID NO: 19489 - RNA, 132 nt, synthetic construct; identical to SEQ ID NO: 19190
  source 1..132: mol_type = other RNA

SEQ ID NO: 19490 - RNA, 133 nt, synthetic construct; identical to SEQ ID NO: 19191
  source 1..133: mol_type = other RNA

SEQ ID NO: 19491 - RNA, 132 nt, synthetic construct; identical to SEQ ID NO: 19192
  source 1..132: mol_type = other RNA

SEQ ID NO: 19492 - RNA, 133 nt, synthetic construct; identical to SEQ ID NO: 19193
  source 1..133: mol_type = other RNA

SEQ ID NO: 19493 - RNA, 134 nt, synthetic construct; identical to SEQ ID NO: 19194
  source 1..134: mol_type = other RNA

SEQ ID NO: 19494 - RNA, 135 nt, synthetic construct; identical to SEQ ID NO: 19195
  source 1..135: mol_type = other RNA

SEQ ID NO: 19495 - RNA, 134 nt, synthetic construct; identical to SEQ ID NO: 19196
  source 1..134: mol_type = other RNA

SEQ ID NO: 19496 - RNA, 135 nt, synthetic construct; identical to SEQ ID NO: 19197
  source 1..135: mol_type = other RNA

SEQ ID NO: 19497 - RNA, 136 nt, synthetic construct; identical to SEQ ID NO: 19198
  source 1..136: mol_type = other RNA

SEQ ID NO: 19498 - RNA, 137 nt, synthetic construct; identical to SEQ ID NO: 19199
  source 1..137: mol_type = other RNA

SEQ ID NO: 19499 - RNA, 136 nt, synthetic construct; identical to SEQ ID NO: 19200
  source 1..136: mol_type = other RNA

SEQ ID NO: 19500 - RNA, 137 nt, synthetic construct; identical to SEQ ID NO: 19201
  source 1..137: mol_type = other RNA

SEQ ID NO: 19501 - RNA, 138 nt, synthetic construct; identical to SEQ ID NO: 19202
  source 1..138: mol_type = other RNA

SEQ ID NO: 19502 - RNA, 139 nt, synthetic construct; identical to SEQ ID NO: 19203
  source 1..139: mol_type = other RNA

SEQ ID NO: 19503 - RNA, 138 nt, synthetic construct; identical to SEQ ID NO: 19204
  source 1..138: mol_type = other RNA

SEQ ID NO: 19504 - RNA, 139 nt, synthetic construct; identical to SEQ ID NO: 19205
  source 1..139: mol_type = other RNA

SEQ ID NO: 19505 - RNA, 140 nt, synthetic construct; identical to SEQ ID NO: 19206
  source 1..140: mol_type = other RNA

SEQ ID NO: 19506 - RNA, 141 nt, synthetic construct; identical to SEQ ID NO: 19207
  source 1..141: mol_type = other RNA

SEQ ID NO: 19507 - RNA, 123 nt, synthetic construct; identical to SEQ ID NO: 19208
  source 1..123: mol_type = other RNA

SEQ ID NO: 19508 - RNA, 124 nt, synthetic construct; identical to SEQ ID NO: 19209
  source 1..124: mol_type = other RNA

SEQ ID NO: 19509 - RNA, 125 nt, synthetic construct; identical to SEQ ID NO: 19210
  source 1..125: mol_type = other RNA

SEQ ID NO: 19510 - RNA, 126 nt, synthetic construct; identical to SEQ ID NO: 19211
  source 1..126: mol_type = other RNA

SEQ ID NO: 19511 - RNA, 125 nt, synthetic construct; identical to SEQ ID NO: 19212
  source 1..125: mol_type = other RNA

SEQ ID NO: 19512 - RNA, 126 nt, synthetic construct; identical to SEQ ID NO: 19213
  source 1..126: mol_type = other RNA

SEQ ID NO: 19513 - RNA, 127 nt, synthetic construct; identical to SEQ ID NO: 19214
  source 1..127: mol_type = other RNA

SEQ ID NO: 19514 - RNA, 128 nt, synthetic construct; identical to SEQ ID NO: 19215
  source 1..128: mol_type = other RNA

SEQ ID NO: 19515 - RNA, 127 nt, synthetic construct; identical to SEQ ID NO: 19216
  source 1..127: mol_type = other RNA

SEQ ID NO: 19516 - RNA, 128 nt, synthetic construct; identical to SEQ ID NO: 19217
  source 1..128: mol_type = other RNA

SEQ ID NO: 19517 - RNA, 129 nt, synthetic construct; identical to SEQ ID NO: 19218
  source 1..129: mol_type = other RNA

SEQ ID NO: 19518 - RNA, 130 nt, synthetic construct; identical to SEQ ID NO: 19219
  source 1..130: mol_type = other RNA

SEQ ID NO: 19519 - RNA, 129 nt, synthetic construct; identical to SEQ ID NO: 19220
  source 1..129: mol_type = other RNA

SEQ ID NO: 19520 - RNA, 130 nt, synthetic construct; identical to SEQ ID NO: 19221
  source 1..130: mol_type = other RNA

SEQ ID NO: 19521 - RNA, 131 nt, synthetic construct; identical to SEQ ID NO: 19222
  source 1..131: mol_type = other RNA

SEQ ID NO: 19522 - RNA, 132 nt, synthetic construct; identical to SEQ ID NO: 19223
  source 1..132: mol_type = other RNA

SEQ ID NO: 19523 - RNA, 131 nt, synthetic construct; identical to SEQ ID NO: 19224
  source 1..131: mol_type = other RNA

SEQ ID NO: 19524 - RNA, 132 nt, synthetic construct; identical to SEQ ID NO: 19225
  source 1..132: mol_type = other RNA

SEQ ID NO: 19525 - RNA, 133 nt, synthetic construct; identical to SEQ ID NO: 19226
  source 1..133: mol_type = other RNA

SEQ ID NO: 19526 - RNA, 134 nt, synthetic construct; identical to SEQ ID NO: 19227
  source 1..134: mol_type = other RNA

SEQ ID NO: 19527 - RNA, 133 nt, synthetic construct; identical to SEQ ID NO: 19228
  source 1..133: mol_type = other RNA

SEQ ID NO: 19528 - RNA, 134 nt, synthetic construct; identical to SEQ ID NO: 19229
  source 1..134: mol_type = other RNA

SEQ ID NO: 19529 - RNA, 135 nt, synthetic construct; identical to SEQ ID NO: 19230
  source 1..135: mol_type = other RNA

SEQ ID NO: 19530 - RNA, 136 nt, synthetic construct; identical to SEQ ID NO: 19231
  source 1..136: mol_type = other RNA

SEQ ID NO: 19531 - RNA, 135 nt, synthetic construct; identical to SEQ ID NO: 19232
  source 1..135: mol_type = other RNA

SEQ ID NO: 19532 - RNA, 136 nt, synthetic construct; identical to SEQ ID NO: 19233
  source 1..136: mol_type = other RNA

SEQ ID NO: 19533 - RNA, 137 nt, synthetic construct; identical to SEQ ID NO: 19234
  source 1..137: mol_type = other RNA

SEQ ID NO: 19534 - RNA, 138 nt, synthetic construct; identical to SEQ ID NO: 19235
  source 1..138: mol_type = other RNA

SEQ ID NO: 19535 - RNA, 137 nt, synthetic construct; identical to SEQ ID NO: 19236
  source 1..137: mol_type = other RNA

SEQ ID NO: 19536 - RNA, 138 nt, synthetic construct; identical to SEQ ID NO: 19237
  source 1..138: mol_type = other RNA

SEQ ID NO: 19537 - RNA, 139 nt, synthetic construct; identical to SEQ ID NO: 19238
  source 1..139: mol_type = other RNA

SEQ ID NO: 19538 - RNA, 140 nt, synthetic construct; identical to SEQ ID NO: 19239
  source 1..140: mol_type = other RNA

SEQ ID NO: 19539 - RNA, 139 nt, synthetic construct; identical to SEQ ID NO: 19240
  source 1..139: mol_type = other RNA

SEQ ID NO: 19540 - RNA, 140 nt, synthetic construct; identical to SEQ ID NO: 19241
  source 1..140: mol_type = other RNA

SEQ ID NO: 19541 - RNA, 141 nt, synthetic construct; identical to SEQ ID NO: 19242
  source 1..141: mol_type = other RNA

SEQ ID NO: 19542 - RNA, 142 nt, synthetic construct; identical to SEQ ID NO: 19243
  source 1..142: mol_type = other RNA

SEQ ID NO: 19543 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19544 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19545 - protein, 1875 aa, synthetic construct
MPAAKRVKLDGGSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19546 - protein, 1875 aa, synthetic construct
MPAAKRVKLDGGSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATAAQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19547 - protein, 1836 aa, synthetic construct
MPAAKRVKLDGGAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19548 - protein, 1836 aa, synthetic construct
MPAAKRVKLDGGAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSEAQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19549 - protein, 2122 aa, synthetic construct
MPAAKRVKLDGGDKKYSIGLDIGTNSVGWAVITDEYKVPSKKFKVLGNTDRHSIKKNLIGALLFDSGETAERTRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFLWPTVAYSVLVVAKVEKGKSKKLKSVKELLGITIMERSSFEKNPIDFLEAKGYKEVKKDLIIKLPKYSLFELENGRKRMLASAKQLQKGNELALPSKYVNFLYLASHYEKLKGSPEDNEQKQLFVEQHKHYLDEIIEQISEFSKRVILADANLDKVLSAYNKHRDKPIREQAENIIHLFTLTRLGAPRAFKYFDTTIDPKQYRSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19550 - protein, 1846 aa, synthetic construct
MPAAKRVKLDGGAYTMGIDVGIASCGWAIVDLERQRIIDIGVRTFEKAENPKNGEALAVPRREARSSRRRLRRKKHRIERLKHMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRSSLLVEIHTLFETQRQHHNSLASKDFELEYVNIWSAQRPVATKDQIEKMIGTCTFLPKEKRAPKASWHFQYFMLLQTINHIRITNVQGTRSLNKEEIEQVVNMALTKSKVSYHDTRKILDLSEEYQFVGLDYGKEDEKKKVESKETIIKLDDYHKLNKIFNEVELAKGETWEADDYDTVAYALTFFKDDEDIRDYLQNKYKDSKNRLVKNLANKEYTNELIGKVSTLSFRKVGHLSLKALRKIIPFLEQGMTYDKACQAAGFDFQGISKKKRSVVLPVIDQISNPVVNRALTQTRKVINALIKKYGSPETIHIETARELSKTFDERKNITKDYKENRDKNEHAKKHLSELGIINPTGLDIVKYKLWCEQQGRCMYSNQPISFERLKESGYTEVDHIIPYSRSMNDSYNNRVLVMTRENREKGNQTPFEYMGNDTQRWYEFEQRVTTNPQIKKEKRQNLLLKGFTNRRELEMLERNLNDTRYITKYLSHFISTNLEFSPSDKKKKVVNTSGRITSHLRSRWGLEKNRGQNDLHHAMDAIVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNVKKAFSTDLHKPKKDGTKGPLIKSVRIMENKTLVHPVNKGKGVVYNSSIVRTDVFQRKEKYYLLPVYVTDVTKGKLPNKVIVAKKGYHDWIEVDDSFTFLFSLYPNDLIFIRQNPKKKISLKKRIESHSISDSKEVQEIHAYYKGVDSSTAAIEFIIHDGSYYAKGVGVQNLDCFEKYQVDILGNYFKVKGEKRLELETSDSNHKGKDVNSIKSTSRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19551 - protein, 1809 aa, synthetic construct
MPAAKRVKLDGGQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANENQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19552 - protein, 1807 aa, synthetic construct
MPAAKRVKLDGGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19553 - protein, 1815 aa, synthetic construct
MPAAKRVKLDGGQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRKLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYKNDLIMYEDELFRVIGVNSDINNLVELNMVDITYKDFCEVNNVTGEKHIKKTIGKRVVLIEKYTTDILGNLYKTPLPKKPQLIFKRGELSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19554 - protein, 1815 aa, synthetic construct
MPAAKRVKLDGGQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSENSKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRQLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYYNDLIMYEDELFRVIGVNSDINNLVELNMVDITYKDFCEVNNVTGEKRIKKTIGKRVVLIEKYTTDILGNLYKTPLPKKPQLIFKRGELSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19555 - protein, 1807 aa, synthetic construct
MPAAKRVKLDGGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19556 - protein, 2129 aa, synthetic construct
MPAAKRVKLDGGEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19557 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19558 - protein, 1846 aa, synthetic construct
MPAAKRVKLDGGAYTMGIDVGIASCGWAIVDLERQRIIDIGVRTFEKAENPKNGEALAVPRREARSSRRRLRRKKHRIERLKHMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRSSLLVEIHTLFETQRQHHNSLASKDFELEYVNIWSAQRPVATKDQIEKMIGTCTFLPKEKRAPKASWHFQYFMLLQTINHIRITNVQGTRSLNKEEIEQVVNMALTKSKVSYHDTRKILDLSEEYQFVGLDYGKEDEKKKVESKETIIKLDDYHKLNKIFNEVELAKGETWEADDYDTVAYALTFFKDDEDIRDYLQNKYKDSKNRLVKNLANKEYTNELIGKVSTLSFRKVGHLSLKALRKIIPFLEQGMTYDKACQAAGFDFQGISKKKRSVVLPVIDQISNPVVNRALTQTRKVINALIKKYGSPETIHIETARELSKTFDERKNITKDYKENRDKNEHAKKHLSELGIINPTGLDIVKYKLWCEQQGRCMYSNQPISFERLKESGYTEVDHIIPYSRSMNDSYNNRVLVMTREAREKGNQTPFEYMGNDTQRWYEFEQRVTTNPQIKKEKRQNLLLKGFTNRRELEMLERNLNDTRYITKYLSHFISTNLEFSPSDKKKKVVNTSGRITSHLRSRWGLEKNRGQNDLHHAMDAIVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNVKKAFSTDLHKPKKDGTKGPLIKSVRIMENKTLVHPVNKGKGVVYNSSIVRTDVFQRKEKYYLLPVYVTDVTKGKLPNKVIVAKKGYHDWIEVDDSFTFLFSLYPNDLIFIRQNPKKKISLKKRIESHSISDSKEVQEIHAYYKGVDSSTAAIEFIIHDGSYYAKGVGVQNLDCFEKYQVDILGNYFKVKGEKRLELETSDSNHKGKDVNSIKSTSRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19559 - protein, 1809 aa, synthetic construct
MPAAKRVKLDGGQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANEAQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVRSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19560 - protein, 1807 aa, synthetic construct
MPAAKRVKLDGGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19561 - protein, 1815 aa, synthetic construct
MPAAKRVKLDGGQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSEASKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRKLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYKNDLIMYEDELFRVIGVNSDINNLVELNMVDITYKDFCEVNNVTGEKHIKKTIGKRVVLIEKYTTDILGNLYKTPLPKKPQLIFKRGELSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19562 - protein, 1815 aa, synthetic construct
MPAAKRVKLDGGQENQQKQNYILGLDIGITSVGYGLIDSKTREVIDAGVRLFPEADSENNSNRRSKRGARRLKRRRIHRLNRVKDLLADYQMIDLNNVPKSTDPYTIRVKGLREPLTKEEFAIALLHIAKRRGLHNISVSMGDEEQDNELSTKQQLQKNAQQLQDKYVCELQLERLTNINKVRGEKNRFKTEDFVKEVKQLCETQRQYHNIDDQFIQQYIDLVSTRREYFEGPGNGSPYGWDGDLLKWYEKLMGRCTYFPEELRSVKYAYSADLFNALNDLNNLVVTRDDNPKLEYYEKYHIIENVFKQKKNPTLKQIAKEIGVQDYDIRGYRITKSGKPQFTSFKLYHDLKNIFEQAKYLEDVEMLDEIAKILTIYQDEISIKKALDQLPELLTESEKSQIAQLTGYTGTHRLSLKCIHIVIDELWESPENQMEIFTRLNLKPKKVEMSEIDSIPTTLVDEFILSPVVKRAFIQSIKVINAVINRFGLPEDIIIELAREKNSKDRRKFINKLQKQNEATRKKIEQLLAKYGNTNAKYMIEKIKLHDMQEGKCLYSLEAIPLEDLLSNPTHYEVDHIIPRSVSFDNSLNNKVLVKQSEASKKGNRTPYQYLSSNESKISYNQFKQHILNLSKAKDRISKKKRDMLLEERDINKFEVQKEFINRNLVDTRYATRELSNLLKTYFSTHDYAVKVKTINGGFTNHLRKVWDFKKHRNHGYKHHAEDALVIANADFLFKTHKALRRTDKILEQPGLEVNDTTVKVDTEEKYQELFETPKQVKNIKQFRDFKYSHRVDKKPNRQLINDTLYSTREIDGETYVVQTLKDLYAKDNEKVKKLFTERPQKILMYQHDPKTFEKLMTILNQYAEAKNPLAAYYEDKGEYVTKYAKKGNGPAIHKIKYIDKKLGSYLDVSNKYPETQNKLVKLSLKSFRFDIYKCEQGYKMVSIGYLDVLKKDNYYYIPKDKYEAEKQKKKIKESDLFVGSFYYNDLIMYEDELFRVIGVNSDINNLVELNMVDITYKDFCEVNNVTGEKRIKKTIGKRVVLIEKYTTDILGNLYKTPLPKKPQLIFKRGELSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19563 - protein, 1807 aa, synthetic construct
MPAAKRVKLDGGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19564 - protein, 2129 aa, synthetic construct
MPAAKRVKLDGGEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGADKKLRKRSGKLATEEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVEARGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASAKELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19565 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 19566 - protein, 2122 aa, synthetic construct; identical to SEQ ID NO: 19543

SEQ ID NO: 19567 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
tataatttgggtagtgtgaagttttagagctagaaatagcaagttaaaataaggctagtccgttatcaacttgaaaaagtggcaccgagtcggtgctttt

SEQ ID NO: 19568 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
atataatttgggtagtgtgagttttagagctagaaatagcaagttaaaataaggctagtccgttatcaacttgaaaaagtggcaccgagtcggtgctttt

SEQ ID NO: 19569 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
agtttcttacctcttctagtgttttagagctagaaatagcaagttaaaataaggctagtccgttatcaacttgaaaaagtggcaccgagtcggtgctttt

SEQ ID NO: 19570 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
tcatcattagaagtgaagtcgttttagagctagaaatagcaagttaaaataaggctagtccgttatcaacttgaaaaagtggcaccgagtcggtgctttt

SEQ ID NO: 19571 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
ttcacttctaatgatgattagttttagagctagaaatagcaagttaaaataaggctagtccgttatcaacttgaaaaagtggcaccgagtcggtgctttt

SEQ ID NO: 19572 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
aatggtgccaggcataatccgttttagagctagaaatagcaagttaaaataaggctagtccgttatcaacttgaaaaagtggcaccgagtcggtgctttt

SEQ ID NO: 19573 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
atattttctttaatggtgccgttttagagctagaaatagcaagttaaaataaggctagtccgttatcaacttgaaaaagtggcaccgagtcggtgctttt

SEQ ID NO: 19574 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
aaagatgatattttctttaagttttagagctagaaatagcaagttaaaataaggctagtccgttatcaacttgaaaaagtggcaccgagtcggtgctttt

SEQ ID NO: 19575 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
accaatgatattttctttaagttttagagctagaaatagcaagttaaaataaggctagtccgttatcaacttgaaaaagtggcaccgagtcggtgctttt

SEQ ID NO: 19576 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
tctgtatctatattcatcatgttttagagctagaaatagcaagttaaaataaggctagtccgttatcaacttgaaaaagtggcaccgagtcggtgctttt

SEQ ID NO: 19577 - RNA, 100 nt, synthetic construct; identical to SEQ ID NO: 19567
  source 1..100: mol_type = other RNA

SEQ ID NO: 19578 - RNA, 100 nt, synthetic construct; identical to SEQ ID NO: 19568
  source 1..100: mol_type = other RNA

SEQ ID NO: 19579 - RNA, 100 nt, synthetic construct; identical to SEQ ID NO: 19569
  source 1..100: mol_type = other RNA

SEQ ID NO: 19580 - RNA, 100 nt, synthetic construct; identical to SEQ ID NO: 19570
  source 1..100: mol_type = other RNA

SEQ ID NO: 19581 - RNA, 100 nt, synthetic construct; identical to SEQ ID NO: 19571
  source 1..100: mol_type = other RNA

SEQ ID NO: 19582 - RNA, 100 nt, synthetic construct; identical to SEQ ID NO: 19572
  source 1..100: mol_type = other RNA

SEQ ID NO: 19583 - RNA, 100 nt, synthetic construct; identical to SEQ ID NO: 19573
  source 1..100: mol_type = other RNA

SEQ ID NO: 19584 - RNA, 100 nt, synthetic construct; identical to SEQ ID NO: 19574
  source 1..100: mol_type = other RNA

SEQ ID NO: 19585 - RNA, 100 nt, synthetic construct; identical to SEQ ID NO: 19575
  source 1..100: mol_type = other RNA

SEQ ID NO: 19586 - RNA, 100 nt, synthetic construct; identical to SEQ ID NO: 19576
  source 1..100: mol_type = other RNA

SEQ ID NO: 19587 - RNA, 20 nt, synthetic construct
  source 1..20: mol_type = other RNA
accattaaagaaaatatcat

SEQ ID NO: 19588 - RNA, 76 nt, synthetic construct
  source 1..76: mol_type = other RNA
gttttagagctagaaatagcaagttaaaataaggctagtccgttatcaacttgaaaaagtggcaccgagtcggtgc

SEQ ID NO: 19589-30420 - skipped (10832 entries)

SEQ ID NO: 30421 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide
ggatggtcctcatgaacgacgttttagagctagaaatagcaagttaaaataaggctagtccgttatcaacttgaaaaagtggcaccgagtcggtgcttaccgctccagtcgttcatgaggac

SEQ ID NO: 30422 - RNA, 122 nt, synthetic construct
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
ggatggtcctcatgaacgacgttttagagctagaaatagcaagttaaaataaggctagtccgttatcaacttgaaaaagtggcaccgagtcggtgcattaccgctccagtcgttcatgagmg

SEQ ID NO: 30423 - RNA, 126 nt, synthetic construct
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide
tcagaggaagctgggccaccgttttagagctagaaatagcaagttaaaataaggctagtccgttatcaacttgaaaaagtggcaccgagtcggtgctggagcggtaatggctggtggcccagcttc

SEQ ID NO: 30424 - RNA, 128 nt, synthetic construct
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide
tcagaggaagctgggccaccgttttagagctagaaatagcaagttaaaataaggctagtccgttatcaacttgaaaaagtggcaccgagtcggtgctggagcggtaatggctggtggcccagcttcct

SEQ ID NO: 30425 - RNA, 127 nt, synthetic construct
  source 1..127: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 124: mod_base = OTHER; note = internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide
ggatggtcctcatgaacgacgttttagagctagaaatagcaagttaaaataaggctagtccgttatcaacttgaaaaagtggcaccgagtcggtgcaggcattaccgctccagtcgttcatgaggac

SEQ ID NO: 30426 - RNA, 125 nt, synthetic construct
  source 1..125: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 122: mod_base = OTHER; note = internucleotide phosphorothioate linkage
  modified_base 123: mod_base = OTHER; note = 2'-O-methyl nucleotide with internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide
ggatggtcctcatgaacgacgttttagagctagaaatagcaagttaaaataaggctagtccgttatcaacttgaaaaagtggcaccgagtcggtgcaggcattaccgctccagtcgttcatgagg

SEQ ID NO: 30427 - protein, 2122 aa, synthetic construct; identical to SEQ ID NO: 19544

SEQ ID NO: 30428 - protein, 2122 aa, synthetic construct; identical to SEQ ID NO: 19543

SEQ ID NO: 30429 - RNA, 122 nt, synthetic construct; identical to SEQ ID NO: 30421
  source 1..122: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 119: mod_base = OTHER; note = internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide with internucleotide phosphorothioate linkage
  modified_base 122: mod_base = OTHER; note = 2'-O-methyl nucleotide

SEQ ID NO: 30430 - RNA, 121 nt, synthetic construct
  source 1..121: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 118: mod_base = OTHER; note = internucleotide phosphorothioate linkage
  modified_base 119: mod_base = OTHER; note = 2'-O-methyl nucleotide with internucleotide phosphorothioate linkage
  modified_base 120: mod_base = OTHER; note = 2'-O-methyl nucleotide with internucleotide phosphorothioate linkage
  modified_base 121: mod_base = OTHER; note = 2'-O-methyl nucleotide
ggatggtcctcatgaacgacgttttagagctagaaatagcaagttaaaataaggctagtccgttatcaacttgaaaaagtggcaccgagtcggtgcattaccgctccagtcgttcatgagg

SEQ ID NO: 30431 - RNA, 126 nt, synthetic construct; identical to SEQ ID NO: 30423
  source 1..126: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 123: mod_base = OTHER; note = internucleotide phosphorothioate linkage
  modified_base 124: mod_base = OTHER; note = 2'-O-methyl nucleotide with internucleotide phosphorothioate linkage
  modified_base 125: mod_base = OTHER; note = 2'-O-methyl nucleotide with internucleotide phosphorothioate linkage
  modified_base 126: mod_base = OTHER; note = 2'-O-methyl nucleotide

SEQ ID NO: 30432 - RNA, 128 nt, synthetic construct; identical to SEQ ID NO: 30424
  source 1..128: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 125: mod_base = OTHER; note = internucleotide phosphorothioate linkage
  modified_base 126: mod_base = OTHER; note = 2'-O-methyl nucleotide with internucleotide phosphorothioate linkage
  modified_base 127: mod_base = OTHER; note = 2'-O-methyl nucleotide with internucleotide phosphorothioate linkage
  modified_base 128: mod_base = OTHER; note = 2'-O-methyl nucleotide

SEQ ID NO: 30433 - RNA, 6369 nt, synthetic construct
  source 1..6369: mol_type = other RNA
atgcctgcggctaagcgggtaaaattggatggtggggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaatcggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaggacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttaatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggaaggcaggcttctgtcgcctcttcatccctgggtttgcagaaatggcagcccccctgtaccctctcaccaaaccggggactctgtttaattggggcccagaccaacaaaaggcctatcaagaaatcaagcaagcccttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggtggctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagaaaaggacggcggatggtagcgaattcgagagccctaaaaagaaggccaaggtagagtaa

SEQ ID NO: 30434 - RNA, 100 nt, synthetic construct
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide
acacaaataccagtccagcggttttagagctagaaatagcaagttaaaataaggctagtccgttatcaacttgaaaaagtggcaccgagtcggtgctttt

SEQ ID NO: 30435 - RNA, 6369 nt, synthetic construct; identical to SEQ ID NO: 30433
  source 1..6369: mol_type = other RNA

SEQ ID NO: 30436 - RNA, 100 nt, synthetic construct; identical to SEQ ID NO: 30434
  source 1..100: mol_type = other RNA
  modified_base 1: mod_base = OTHER; note = 2'-O-methyl nucleotide with internucleotide phosphorothioate linkage
  modified_base 2: mod_base = OTHER; note = 2'-O-methyl nucleotide with internucleotide phosphorothioate linkage
  modified_base 3: mod_base = OTHER; note = 2'-O-methyl nucleotide with internucleotide phosphorothioate linkage
  modified_base 29: mod_base = OTHER; note = 2'-O-methyl nucleotide
  modified_base 30: mod_base = OTHER; note = 2'-O-methyl nucleotide
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide
  modified_base 37: mod_base = OTHER; note = 2'-O-methyl nucleotide
  modified_base 38: mod_base = OTHER; note = 2'-O-methyl nucleotide
  modified_base 39: mod_base = OTHER; note = 2'-O-methyl nucleotide
  modified_base 40: mod_base = OTHER; note = 2'-O-methyl nucleotide
  modified_base 69: mod_base = OTHER; note = 2'-O-methyl nucleotide
  modified_base 70: mod_base = OTHER; note = 2'-O-methyl nucleotide
  modified_base 71: mod_base = OTHER; note = 2'-O-methyl nucleotide
  modified_base 72: mod_base = OTHER; note = 2'-O-methyl nucleotide
  modified_base 73: mod_base = OTHER; note = 2'-O-methyl nucleotide
  modified_base 74: mod_base = OTHER; note = 2'-O-methyl nucleotide
  modified_base 75: mod_base = OTHER; note = 2'-O-methyl nucleotide
  modified_base 76: mod_base = OTHER; note = 2'-O-methyl nucleotide
  modified_base 77: mod_base = OTHER; note = 2'-O-methyl nucleotide
  modified_base 78: mod_base = OTHER; note = 2'-O-methyl nucleotide
  modified_base 79: mod_base = OTHER; note = 2'-O-methyl nucleotide
  modified_base 80: mod_base = OTHER; note = 2'-O-methyl nucleotide
  modified_base 81: mod_base = OTHER; note = 2'-O-methyl nucleotide
  modified_base 82: mod_base = OTHER; note = 2'-O-methyl nucleotide
  modified_base 83: mod_base = OTHER; note = 2'-O-methyl nucleotide
  modified_base 84: mod_base = OTHER; note = 2'-O-methyl nucleotide
  modified_base 85: mod_base = OTHER; note = 2'-O-methyl nucleotide
  modified_base 86: mod_base = OTHER; note = 2'-O-methyl nucleotide
  modified_base 87: mod_base = OTHER; note = 2'-O-methyl nucleotide
  modified_base 88: mod_base = OTHER; note = 2'-O-methyl nucleotide
  modified_base 89: mod_base = OTHER; note = 2'-O-methyl nucleotide
  modified_base 90: mod_base = OTHER; note = 2'-O-methyl nucleotide
  modified_base 91: mod_base = OTHER; note = 2'-O-methyl nucleotide
  modified_base 92: mod_base = OTHER; note = 2'-O-methyl nucleotide
  modified_base 93: mod_base = OTHER; note = 2'-O-methyl nucleotide
  modified_base 94: mod_base = OTHER; note = 2'-O-methyl nucleotide
  modified_base 95: mod_base = OTHER; note = 2'-O-methyl nucleotide
  modified_base 96: mod_base = OTHER; note = 2'-O-methyl nucleotide
  modified_base 97: mod_base = OTHER; note = 2'-O-methyl nucleotide with internucleotide phosphorothioate linkage
  modified_base 98: mod_base = OTHER; note = 2'-O-methyl nucleotide with internucleotide phosphorothioate linkage
  modified_base 99: mod_base = OTHER; note = 2'-O-methyl nucleotide with internucleotide phosphorothioate linkage
  modified_base 100: mod_base = OTHER; note = 2'-O-methyl nucleotide

SEQ ID NO: 30437-37634 - skipped (7198 entries)

SEQ ID NO: 37635 - protein, 4 aa, unidentified
YADD

SEQ ID NO: 37636 - protein, 4 aa, unidentified
YMDD

SEQ ID NO: 37637 - protein, 4 aa, unidentified
YVDD

SEQ ID NO: 37638 - protein, 9 aa, unidentified
LAGLIDADG

SEQ ID NO: 37639 - skipped

SEQ ID NO: 37640 - RNA, 100 nt, synthetic construct
  source 1..100: mol_type = other RNA
  misc_difference 1..100: note = This sequence may encompass 5, 10, 20, 30, 50, 70, or 100 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 37641 - RNA, 20 nt, synthetic construct
  source 1..20: mol_type = other RNA
acacaaataccagtccagcg

SEQ ID NO: 37642 - DNA, 16 bp, synthetic construct
  source 1..16: mol_type = other DNA
gcgcgctcgctcgctc

SEQ ID NO: 37643 - DNA, 20 bp, synthetic construct
  source 1..20: mol_type = other DNA
gccgaagcactgcacgccgt

SEQ ID NO: 37644 - DNA, 76 bp, synthetic construct
  source 1..76: mol_type = other DNA
gttttagagctagaaatagcaagttaaaataaggctagtccgttatcaacttgaaaaagtggcaccgagtcggtgc

SEQ ID NO: 37645 - DNA, 13 bp, synthetic construct
  source 1..13: mol_type = other DNA
accctgacgtacg

SEQ ID NO: 37646 - DNA, 13 bp, synthetic construct
  source 1..13: mol_type = other DNA
gcgtgcagtgctt

SEQ ID NO: 37647 - DNA, 20 bp, synthetic construct
  source 1..20: mol_type = other DNA
agaagtcgtgctgcttcatg

SEQ ID NO: 37648 - DNA, 47 bp, synthetic construct
  source 1..47: mol_type = other DNA
accctgacctacggcgtgcagtgcttcggccgctaccccgatcacat

SEQ ID NO: 37649 - DNA, 13 bp, synthetic construct
  source 1..13: mol_type = other DNA
gaagcagcacgac

SEQ ID NO: 37650 - protein, 6 aa, synthetic construct
IENSSP
